United States Patent 11,098,302 (IDENTIFICATION OF POLYNUCLEOTIDES ASSOCIATED WITH A SAMPLE) - sequence listing, part 108

SEQ ID NO: 371502 - DNA, 581 bp, Homo sapiens
  misc_feature: GZ8MTXP02H8G0T.15.67.G01.1.454.CMB.2.raw
  modified_base (488)..(488): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtctgggggaggcttggtccgaggccggggggtccctgagactctcctgtgcagtctctggattcacccttagaagttatggatgacctgggtccgccaggctccgaggggaaggggctgggaggtggggtggaccgaaacaataaaacgaaaggaacggaaagtacaagaaaaacctatgtaggactctgtgacggccgattcaccatctaccagacgacaaccgaccaaagtaatcacttgtattgaacaatgaaacagtccagagaggacgacggaacncggacctgtaagttattggtgacgcggagtagttgaaagtaggttacaccgttacaacgtaagtaagctaagggtgtaagtcggtatttacgg

SEQ ID NO: 371503 - DNA, 530 bp, Homo sapiens
  misc_feature: GZ8MTXP02F3AAK.15.67.G01.1.454.CMB.2.raw
  modified_base (306)..(306): a, c, t, g, unknown or other
  modified_base (417)..(417): a, c, t, g, unknown or other
  modified_base (492)..(492): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttattggatgacctgggtccnccaggctccgaggggaagggctggagtggggtggccaaacataaaacaaagacggaaagtcaagaaaaacctatgtaggactctgtgacggccgattcaccatctccaganacaacgcaaagatcactgtattgacaaatgaaacagctgagaggcgagacacggcgtgtattatgtgcgacgagntagatagagactcagaagtagacgaggtgtatgacttg

SEQ ID NO: 371504 - DNA, 729 bp, Homo sapiens
  misc_feature: GZ8MTXP02HC4GB.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcggtgggggaggtcgttggtccgagggtcccggggggtccctggacgacttctccgtgtgctagtctcgtggtacttcctaccttagaagtttagtggatcgaccgttcgggccgccgaggcctaccggaggggaggggcgtgggaggtgggtcggaccaaacaaataaaacgaaaggaacggtaaagtacgaaaagtaaaaaaccctgtaggtacggtaacttcgttaggacggaccgggtcctaattccaaccacttaccgacccaaaggaacgaaaccgaaccggaaccctaaagtaaacttacgtacttagttaatttacgaaactaaaagtacgaaaaccgacggtacctagggaaggaacgggaccgggaaaggacccggtaacgggtccggttaggtttaatttagtttgggacgccggtacggaaggttagtaggtaaagttaaccgggtaagtacccttagtaaaccgtaaggtaacgacggttagggttaggtaagttggtaatttccgg

SEQ ID NO: 371505 - DNA, 552 bp, Homo sapiens
  misc_feature: GZ8MTXP02IY0P9.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaagggctgggagtggggtggccaaacataaaacaaagaacggaagtacaagaaaaacctatagtaggactctggtagacggccgattccaccatctaccagagacaacgccaaagaattcactgtatttgacaaatgaaactagcctagagaggcgaggacacggccgtgtattagtgtagcgacgagatgatagtagactctacgaagtagacgtaggtagtactagattg

SEQ ID NO: 371506 - DNA, 586 bp, Homo sapiens
  misc_feature: GZ8MTXP02ISGOZ.15.67.G01.1.454.CMB.2.raw
  modified_base (357)..(357): a, c, t, g, unknown or other
  modified_base (473)..(473): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttgggtgggagtcggtggggggaggtctttgggtcccgagggcccgggggggtccctggagacctctcctgtgcagtctcgtggattcacccttagaagttattggatgacctgggtccgccaggctccgaggggagggctgggagtgggtgccaanataaacaaagacggaagtacaagaaaactgtagtgactcgtgtagaccgggccgattccacctatcctaccgagaacgacaaccgaccaaagaacttacacttcgttatttacganaaaatgaaacacgccgtagagacgggcgaaggaccgacggccgtgtaattagttgtagcggacgagatgaatagtacgactctacgaagtacgagtaggtggtaatcgatttg

SEQ ID NO: 371507 - DNA, 679 bp, Homo sapiens
  misc_feature: GZ8MTXP02I2M08.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcgcttggtggagtcgtgggggaggcttggtccaggccgggggggtccctgagactctcctgtgcagtctctggattcacccttagagttattggatgacctgggtccgccaggctccgaggggagggctggagtgggtgaccaaacaataaacaaagacggaagtacaaagaaaaacctgtagtggactcgtggtacgaccgggccgtaatttccaacctattcctaccgaagaacgaaccaaaccggacccaaaagaactttccaacttggttaacttttaggaactaaaagtacgaaaaccgagtacccgtaggaaggacgggacgggaaagggaacccgtacggggacccggtttaggttaaactttagttggtcgtccggtacggaaggtagttaggtaaacttagggttaaacgacgttacccttaaacgaacggtttaaggaccggtaaggggttaggtaaatggtaagtttcccgg

SEQ ID NO: 371508 - DNA, 562 bp, Homo sapiens
  misc_feature: GZ8MTXP02FT052.15.67.G01.1.454.CMB.2.raw
  modified_base (554)..(554): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtgggtggccaaacataaacaaagacggaaagtcaagaaaaacctatagtgactctgtgacggccgattcaccatctcagagacaacgccaaagaattcactgtatttgacaaaatgaaacacgcctagaggaggaccggaggaccacggccgtgttagttatgtgcgacgaggattggaataggtacgaacttcgttaacaagtacgagtagggtggtaanggtattgg

SEQ ID NO: 371509 - DNA, 565 bp, Homo sapiens
  misc_feature: GZ8MTXP02HNR7W.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccccttagaagttattggatgaccgtgggtcccgccaggctccgaggggaagggctgggagtggggtggccaaacataaaacaaaagacggaagtcaagaaaaacctatagtggactctgtagaccggccgattccaccatcctaccaagacgacaaacgaccaaagaattacactgtaatttgacaaatgaaacagacctggagaggcgaggacgacggcgtaggtattagtgtgcgcgagatgaatagtacgacttctacaagtacgactaggggtagtatgtagttcg

SEQ ID NO: 371510 - DNA, 571 bp, Homo sapiens
  misc_feature: GZ8MTXP02HY9V5.15.67.G01.1.454.CMB.2.raw
  modified_base (352)..(352): a, c, t, g, unknown or other
  modified_base (523)..(523): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggaggtcgtggggggaggtcgttgggtccgagggcccgggggggtccctggagactctcctgtgcagtctctggattccacccttagaagttatggatgacctgggtccgccaggctccgaggggagggctggagtgggtggccaanaataaaacaaagaacggaaagtacaagaaaaaacctatagtaggactctaggtgaccgggccgtaattccaccatccgtaccagaagacaacgaccaaagaatcactgtatttgactaaatagaaacagcctagagaggacggagacgaacggccgtagtattagttgtgngcgagatgagtagtagactctagaagtagacgaggtagtagtgagttg

SEQ ID NO: 371511 - DNA, 581 bp, Homo sapiens
  misc_feature: GZ8MTXP02IRGFQ.15.67.G01.1.454.CMB.2.raw
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggcttgggtccgagggcccggggggggtccctggacgactctcctggtgcagtctctggattcctacccttagaagttattggatgacctgggtccgccaggctccgaggggaagggctggaggtgggtggccaaacataaaacaaaggaacggaagtacaaagaaaaacctatagtgactctgtacgacggccgattcaccatctcagacgaacaacgaccaaagattacaactgttaatttgacaaagtagaacagcctagagagggacgaggacacgggctggtattagttgtgcgtcggagngtagaagtagtacgtactactaacgaagttaggacagggtagtatggtactttgg

SEQ ID NO: 371512 - DNA, 560 bp, Homo sapiens
  misc_feature: GZ8MTXP02INDM5.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggccgggggggtccctgagactctcctgtgcagtctctggattcacccttagagttatggatgacctggccgccaggctcgaggggagggctggagtgggtggaccaaacaataaacaaaggacggaagtacaagaaaaacctatgtaggactctaggtcgaccggggccaattccaaccctatctaccagagacaaaccgccaaagaattcactgtattgacaaatgaacagccagagaggacgaggaccacggcgtgtattagtgtgcgtacgagtatagtataaggtacgaactactaacgaagtagacgtaggtagtatagtaattcg

SEQ ID NO: 371513 - DNA, 553 bp, Homo sapiens
  misc_feature: GZ8MTXP02JBCR7.15.67.G01.1.454.CMB.2.raw
  modified_base (383)..(383): a, c, t, g, unknown or other
  modified_base (420)..(420): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtgggggaggcttggtccaggcccgggggggtccctggagacctctcctgtgcagtctctggattcacccttagaagttattggatgacctgggtccgccaggctccgaggggaaggggctggagtggggtggccaaacataaaacaaagacggaatacgaagaaaaacctntcgtaggactctgtgacgggcattcaccatctcaganacaacgccaaagattcactgtatttgcaaatagacagactcgagaggacgaggacgacggaccgtgtatattgtgcgcgagatagtagtagtagactactacgtaagtagacgaggtaggtagtagtagttcg

SEQ ID NO: 371514 - DNA, 545 bp, Homo sapiens
  misc_feature: GZ8MTXP02HFUDO.15.67.G01.1.454.CMB.2.raw
  modified_base (412)..(412): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctggagactctcctgtgcagtctctggattcacccttagagttattggatgacctgggtccgccaggctccgaggggaaggggctgggagtgggtggccaacataaaacaaagacggaagtcaagaaaaacctatgtaggactctgtgacgggccgaattccaccatcnccagagacaaacgccaaagaattcactgtatttgacaaatgaaacagcctagagaggcgaggacacggccgtagtattatgtgcgacgagatgactagacgactactacaagtagcgaggtggtatggattcg

SEQ ID NO: 371515 - DNA, 543 bp, Homo sapiens
  misc_feature: GZ8MTXP02F8GRR.15.67.G01.1.454.CMB.2.raw
  modified_base (391)..(391): a, c, t, g, unknown or other
  modified_base (413)..(413): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtggggtggccaaacataaaacgaaagacggaagtcaagaaaaacctatgtaggactcngtgacggccgattccaccatcnccagagacaacgccaaagactcactgtattgcaaatgaacagacctgagaggcgaaggacacggcgtgttattatgtgcgtcgagataggatagtacgaactctacaagtacgacgaggtgtatgacttg

SEQ ID NO: 371516 - DNA, 536 bp, Homo sapiens
  misc_feature: GZ8MTXP02IG3L4.15.67.G01.1.454.CMB.2.raw
  modified_base (416)..(416): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcaccccttagaagttattggatgacctgggtccgccaggctccgaggggaaggggctggagtgggtggccaaacataaaacaaagacggaagtacaagaaaaacctatgtggactcgtgtgacgccgattcaccatctcaganacaacgcaagaatcactgtatttgacaaatgaacagcctagagaggcggaggacacggccgtgtattattgtgcgcgagatgtatagtacgactatacaagtagcgaggtagtatgtatg

SEQ ID NO: 371517 - DNA, 638 bp, Homo sapiens
  misc_feature: GZ8MTXP02GFNLM.15.67.G01.1.454.CMB.2.raw
  modified_base (303)..(303): a, c, t, g, unknown or other
  modified_base (309)..(309): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttctgtagtatttagaaggtgtcagtgtgaggtgcacttggtggagtcgtgggggaggcttggtccgaggcccgggggggtccctggagactctcctgtgcagtctctggattcaccttagaagttattggatcgactggggtcccncgagcncggaggggacggtcgtggaggtgggtacgaccaaacgaaagtaaaacgaaaggaacggaaagtacgaaaagaaaactgtaggtacgtactgtagtacggaccggtctacttaccacctactccaccgaagacgaaccaaaccgtacaaagtaacttacgtacgttagttacttacgaataaagtaacgtaacgacgtacgtacggaggacgggacggaacggaaccggaccggtacgtagttacgttagttagtcgtcggtacggtagtagtacgtagtacgtacgtacgtacgtacgtaagtagtacggtaggtaggtagtagtagtg

SEQ ID NO: 371518 - DNA, 537 bp, Homo sapiens
  misc_feature: GZ8MTXP02G4C1W.15.67.G01.1.454.CMB.2.raw
  modified_base (348)..(348): a, c, t, g, unknown or other
  modified_base (455)..(455): a, c, t, g, unknown or other
  modified_base (495)..(495): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggcccggggggggtccctggagactctcctgtgcagtctctggattcacccttagaagttattgggatgacctgggtccgccaggctccgaggggaggggctggagtgggtggccaanataaaacaaagacggaagtacaagaaaaacctatgtggactctgtgacggccgattcaccatctccagagacaacgccaaagaatcactgtatttgacaaatgaaangcctggagaggacgaggacacggcgtagtattatgtgcgngagatgatagtagactactagaagtagcaggtggatgattcg

SEQ ID NO: 371519 - DNA, 544 bp, Homo sapiens
  misc_feature: GZ8MTXP02IEUXD.15.67.G01.1.454.CMB.2.raw
  modified_base (345)..(345): a, c, t, g, unknown or other
  modified_base (429)..(429): a, c, t, g, unknown or other
  modified_base (495)..(495): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctggagtggggtggccaaanataaacaaagacggaagtcagaaaaacctatgtggactctgtgacggccgtattccaccatctcagagacaacgccaaagaatnactgttattgacaaatgaacagcctagagagggcgaggacacggccgtgtattatgtgcgacgtanagtgataagtacgacttcaacgaagtagctagggtagtatcgtagttcg

SEQ ID NO: 371520 - DNA, 553 bp, Homo sapiens
  misc_feature: GZ8MTXP02GWSUI.15.67.G01.1.454.CMB.2.raw
  modified_base (383)..(383): a, c, t, g, unknown or other
  modified_base (461)..(461): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctggagactctcctgtgcagtctctggattcacccttagaagttattggatgacctgggtccgccaggctccgaggggaaggggctgggagtggggtggccaaacgataaaacaaaagacggaagtacaagaaaaacctangtggactctgtgacggccgattcaccatctccagagacaaacgccaaagaattcaactgtaatttgacaaatagaaanaagacctgagaggagaggacgacgcgtgtattattgtgcgcgaganagagtagtacgactactacaagtagacgaggtaggtagtagtagtg

SEQ ID NO: 371521 - DNA, 579 bp, Homo sapiens
  misc_feature: GZ8MTXP02IL1RW.15.67.G01.1.454.CMB.2.raw
  modified_base (521)..(521): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggtccctgagactctcctgtgcagtctctggattcacccttagaagttattggatgacctgggtccgccaggctccgaggggaaggggctgggagtgggtggccaaacgataaaacgaaagacggaaagtacaagaaaaacctatgtaggactctgtagacgggccgattccaccatctcagagacacgcaagattcatgtattgacaatgaaacagcctagagacggcgaaggacgacggccgtagtattattgagtccgaggagagtgtaagtaacgttanaccgttactaaacgtaagttaaccggcgtaaggggttagttagtacggtaattttcgg

SEQ ID NO: 371522 - DNA, 552 bp, Homo sapiens
  misc_feature: GZ8MTXP02JMM06.15.67.G01.1.454.CMB.2.raw
  modified_base (375)..(375): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactcccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgcaggctccgaggggaaggggctggagtggggtgacaaacataaaacaaagacggaatcaagaaaaacctnagtggactctgtgacggccatcgaccatctcagagacaacgcaagattcactgtatttgacaaatgaaacagacctagagagggcgaaggactacggccgttagtatttaagtgtagccgacgagatagaactaggtanactactaagaagtacgacgtaggtagtatcgaagttcg

SEQ ID NO: 371523 - DNA, 583 bp, Homo sapiens
  misc_feature: GZ8MTXP02IXFKA.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctggagactctcctgtgcagtctctggattcacccttagaagttatggatgacctgggtccgccaggctccgaggggaaggggctgggaggtgggtggacccaaacaataaaacaaaaggacggaagtacgaaagaaaaacctatagtaggactcgtgagaccgggccgattccaccatctaccagacgaacaacgacccaaagaacttcaacttgtaatttgaacaaatacgaaacagtacctaggaagagggacgaaggaccgacggccgttagtatttagttagtgtagcgagatgtatagtagactctacgaagtacgacgaggtggtaatgattgg

SEQ ID NO: 371524 - DNA, 545 bp, Homo sapiens
  misc_feature: GZ8MTXP02FKQ4L.15.67.G01.1.454.CMB.2.raw
  modified_base (503)..(503): a, c, t, g, unknown or other
  modified_base (519)..(519): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagaactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctgggagtggggtggccaaacaataaaacaaaagacggaaagtcaagaaaaaacctatgtggaactctgtgacggccgattcaccatctccagagacaaacgccaaagaattcactgtatttgacaaaatgaaacagcctagagaggcgaaggacgacggccgtgtattattgtgcgngagatgatagtagacnctacaagtagcgaggtggtatgattg

SEQ ID NO: 371525 - DNA, 528 bp, Homo sapiens
  misc_feature: GZ8MTXP02FGRYM.15.67.G01.1.454.CMB.2.raw
  modified_base (304)..(304): a, c, t, g, unknown or other
  modified_base (372)..(372): a, c, t, g, unknown or other
  modified_base (524)..(524): a, c, t, g, unknown or other
tcagtctacgtagccacgaccggtgctcgatttagagtatacatattgggtttgatgtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccncaggctccagggaaggggctggagtgggtggccaaacataaaacaaagacggaagtcaagaaaaactngtggactctgtgaacggccgattcaccatctccagagacaacgccaagaattcactgtatttgacaaatgaaacagcctgagagggcgaggacacggccgtgtattattgtgcgcgagatgatagtacgactctaacgagtagcaggtaganggta

SEQ ID NO: 371526 - DNA, 545 bp, Homo sapiens
  misc_feature: GZ8MTXP02I9YDP.15.67.G01.1.454.CMB.2.raw
  modified_base (384)..(384): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttatggatgacctgggtccgccaggctccgaggggaaggggctggagtggggtggccaacataaacaaagacggaagtacaagaaaacctagtgtggactntgtgacggcgattcaccatctccagagacaacgaccaaagaattcactgtatttagacaaatgaaacagcctaggagagggcgaaggacacgggcgtggtattgttagtgcgacgagatggatagtacgactcacgaagtagcgaggtggtatcgatttgg

SEQ ID NO: 371527 - DNA, 546 bp, Homo sapiens
  misc_feature: GZ8MTXP02GZANK.15.67.G01.1.454.CMB.2.raw
  modified_base (428)..(428): a, c, t, g, unknown or other
  modified_base (509)..(509): a, c, t, g, unknown or other
  modified_base (525)..(525): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggcccgggggggtccctggagactctcctgtgcagtctctggattcacccttagaagttatggatgacctgggtcccgccaggctccgaggggaaggggctggaggtggggtggccaacataaaacaaagaacggaagtacaagaaaaacctatagtaggactctgtacgacggccgattccgaccatctaccaganacaacgaccaagaatcactgtatttgacaatgaaacagcctagagaggcggagacgacgcgtgtattagtgtgcgcgaganagatacgacgactcanaagtagcgaggtgtatgattg

SEQ ID NO: 371528 - DNA, 540 bp, Homo sapiens
  misc_feature: GZ8MTXP02FXSEE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccggggggtccctgagactctcctgtgcagtctctggattcacccttagaagttatggatgacctgggtccgccaggctccgaggggaaggggctggagtgggtggccaaacataaaacaaaagacggaagtacaagaaaaacctatgtaggactctgtagacggccgattcaccatctccagagacaacgccaaagaattcactgtatttagacaaaatgaaacagcctagagaggacgagacacggccgtagtattatgtgcgacgagatgatagtagactacacaagtagctagggtgtaatgattg

SEQ ID NO: 371529 - DNA, 532 bp, Homo sapiens
  misc_feature: GZ8MTXP02GFM8O.15.67.G01.1.454.CMB.2.raw
  modified_base (303)..(303): a, c, t, g, unknown or other
  modified_base (341)..(341): a, c, t, g, unknown or other
  modified_base (486)..(486): a, c, t, g, unknown or other
  modified_base (490)..(490): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccnccaggctccgagggaggggctggagtgggtggccaaanataaaacaaagacgaagtcaagaaaaacctatgtggactctgtgacggccattcaccatctccagagacaacgccaaagaattcaactgtatttgacaaatgaaacagcctgagaggacgaggacacggcgtgtattatgtgcgngagntgatagtacgactctacaagtacgcgtaggtggtatgacttg

SEQ ID NO: 371530 - DNA, 554 bp, Homo sapiens
  misc_feature: GZ8MTXP02GXD4O.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccggggggtccctgagactctcctgtgcagtctctggattcacccttagaagttattggatgacctgggtccgccaggctccgaggggagggctggagtgggtggccaacataaacaaagacggaagtacaagaaaaacctatgtaggactcgtgtagaccggccgattcgaccatctaccagacgacaaacgccaaagaattcaacttgtatttagactaaaatgaaacagcctagagaggacgaggacacgggcgtgtacttagtgtgcgacgagatgatagtacgacttcaacaagtacgacgtaggtgtatggatttg

SEQ ID NO: 371531 - DNA, 680 bp, Homo sapiens
  misc_feature: GZ8MTXP02IUCU0.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagagttattggatgaccgtgggtccgccgaggcctccgaggggaaggggcgtagggaggtggggtcggaccaaacaataaaacgaaaggaacggaagtacgaaagaaaaacctagtagtaggactcgtaggtacgaccgggccgtaattccgaacctactcctaccaagaacgaaccaaaccggacccaaagtaacttaccaacttaggttaattttacggaacctaaaagtacgaaaacgacgaccgtagggaaggacgggaccggaagggaaccgaccggggtaccgttagttaacgtttagttcggtacggaccggtacggaaggtagtacggtaaagttaaggttacgaaccttacgtaacgaagttagacgtagggtagtagtcggtagtttcgg

SEQ ID NO: 371532 - DNA, 545 bp, Homo sapiens
  misc_feature: GZ8MTXP02FLE4J.15.67.G01.1.454.CMB.2.raw
  modified_base (412)..(412): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtgggtggaccaacaataaacaaaagacggaagtacaagaaaaacctagtgtaggactctgtagacggcgattcaccatcnccagagacaacgccaaagattcactgtatttgacaaatgaaacagcctagagaggacggagaccgacggccgtagtattagttgtgcgacgagatagatacgtagactcacaagtagacgaggtgtatgattg

SEQ ID NO: 371533 - DNA, 535 bp, Homo sapiens
  misc_feature: GZ8MTXP02F5HZ5.15.67.G01.1.454.CMB.2.raw
  modified_base (298)..(298): a, c, t, g, unknown or other
  modified_base (367)..(367): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttctgtgttatttagaaggtgtcagtgtgaggtgcacttggtggagtcgtgggggaggcttggtccaggccggggggggtccctggagactctcctgtgcagtctctggattcacccttagagttattggatgactggtccnccagctccaggggaagggctggagtgggtggccaacataaacgaaagacggaagtacaagaaaaacctntagtggactctgtagacggccgattcaccatctccagagacaacgcaaagaattcatgtatttgacaaatgaaacagcctgagaggcgagacgacggcgtgtattagtgtgcgcgagagtagagtagtagtactactacgaagtagacgtaggtaggtagtgtagttg

SEQ ID NO: 371534 - DNA, 527 bp, Homo sapiens
  misc_feature: GZ8MTXP02FJW42.15.67.G01.1.454.CMB.2.raw
  modified_base (379)..(379): a, c, t, g, unknown or other
  modified_base (410)..(410): a, c, t, g, unknown or other
  modified_base (487)..(487): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaagttattggatgacctgggtccgcaggctccaggggaaggggctggagtggggtggccaaacataaaacaaagacggaagtcaagaaaaacctatgngactctgtgacgcgattcaccatctccaganacaacgccaagaattcactgtatttgacaaatgaaacagcctagagaggcgagacacggcgtgtatatgtgcgcganatgatagtagactctacaagtagacgaggtgtaactgatg

SEQ ID NO: 371535 - DNA, 559 bp, Homo sapiens
  misc_feature: GZ8MTXP02JG3WO.15.67.G01.1.454.CMB.2.raw
  modified_base (534)..(534): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtgggggaggcttgggtccgaggcccgggggggtccctggagactctcctgtgcagtctctggattcacccttagaagttattggatgacctgggtccgccaggctccgaggggaaggggctgggagtggggtggccaaacgataaaacaaagacggaaagtacaagaaaaacctatagtggactctgtaggaccgggccgaattccacctatctccagagacaacgaccaagaattcactgtatttagacaaatgaaacagcctagagaggcgagacacggcgtgtattagtgtagcgcgtagatgaatagtagactctaanaagtagcgaggtggtatcgtattag

SEQ ID NO: 371536 - DNA, 518 bp, Homo sapiens
  misc_feature: GZ8MTXP02F2XBZ.15.67.G01.1.454.CMB.2.raw
  modified_base (408)..(408): a, c, t, g, unknown or other
  modified_base (440)..(440): a, c, t, g, unknown or other
  modified_base (445)..(446): a, c, t, g, unknown or other
  modified_base (473)..(473): a, c, t, g, unknown or other
  modified_base (477)..(477): a, c, t, g, unknown or other
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctctgtgcagtctctggattcacccttagagttattggatgacctgggtccgccaggctccaggggaagggctggagtggggtgccaacataaacaaagacggaagtcaagaaaaacctatgtaggactctagtgacggccgattcaccatctccanagacaacgcaagaatcactgtatttgcaaatnaaacnncctgagagcgagacaggctgtatatgngcgnagatgatacgtagactctagaagtagcaggtgtangacttg

SEQ ID NO: 371537 - DNA, 551 bp, Homo sapiens
  misc_feature: GZ8MTXP02F4BA8.15.67.G01.1.454.CMB.2.raw
  modified_base (424)..(424): a, c, t, g, unknown or other
  modified_base (525)..(525): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgacctgggtccgccaggcctccgaggggaagggctggagtgggtggaccaaacaataaaacgaaaagacggaagtacaaagaaaaaccctagtgtaggactctggtagacggccgattcaccatctccaganacaacgaccaaagaatcactgtattgacaaatgaaacagcctagagaggacgagaccgacggcgtgtattatgtgcgcgagatgaatacgtagtactctanaagtagacgaggtagtatggactttg

SEQ ID NO: 371538 - DNA, 535 bp, Homo sapiens
  misc_feature: GZ8MTXP02HCPSP.15.67.G01.1.454.CMB.2.raw
  modified_base (304)..(304): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccnccaggctccaggggaaggggctggagtgggtgccaaacataaaacaaagacggaagtcaagaaaaaacctatagtggaactctgtgacggccgattcaccatctaccagagacaacgaccaaagaatcactgtattgacaaatagaaacagcctagagagcgagacacggcgtgtattattgtgcgtcgagatagatagtagactctacaagtagacgaggtagtatgatg

SEQ ID NO: 371539 - DNA, 581 bp, Homo sapiens
  misc_feature: GZ8MTXP02GVPKV.15.67.G01.1.454.CMB.2.raw
  modified_base (543)..(543): a, c, t, g, unknown or other
tcagtctacgtagccacgaccggtgctcgatttagagtatacatattgggtttgaggtctcagagaggagccttagccctggactccaaggcctttccacttggtgatcagcactagagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctggaggtgggtggaccaacaataaaacaaaggaacggaaagtacaaagaaaaaacctatagtaggacttcgtggttacgaaccggggccgtattccgaacccattcctaccaagacgaacaaacgcccaaagaacttcactgttaatttcgactaaatagaaacacgcctaggagagggacggaggaaccgacggcgtgtattatgtgcgcgagangatagtacactctacgaagagacagggtagatgattag

SEQ ID NO: 371540 - DNA, 526 bp, Homo sapiens
  misc_feature: GZ8MTXP02F7YES.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctggagtggggtggccaacataaacaaagacggaagtcaagaaaaacctatgtgactctgtgacggccgattcaccatctccagagacaacgccaaagaattcactgtatttgcaaatgaaacagcctagagaggacgagacacggcgtgtattatgtgcgcgagatgatagtagactcacaagtagcaggtgtatgatcg

SEQ ID NO: 371541 - DNA, 563 bp, Homo sapiens
  misc_feature: GZ8MTXP02HW3P5.15.67.G01.1.454.CMB.2.raw
  modified_base (389)..(389): a, c, t, g, unknown or other
  modified_base (392)..(392): a, c, t, g, unknown or other
  modified_base (410)..(410): a, c, t, g, unknown or other
  modified_base (416)..(416): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtggggtggccaacataaaacaaagacggaaagtacaagaaaaacctatgtagactntgngacggcgattcaccatcnccaganacaacgaccaaagaattcactgttaatttgactaaaatagaaacagaccttaggaggaagggcggaggacgacggaccgtgtattagttgtgacgcgagatgataagtagacttacgtacaagttagactaggtagtagtagtatgg

SEQ ID NO: 371542 - DNA, 574 bp, Homo sapiens
  misc_feature: GZ8MTXP02FUED7.15.67.G01.1.454.CMB.2.raw
  modified_base (393)..(393): a, c, t, g, unknown or other
  modified_base (449)..(449): a, c, t, g, unknown or other
  modified_base (499)..(499): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttatggatgacctgggtccgccaggctccgaggggaaggggctgggaggtgggtcggccaaacaataaacgaaaggaccggaagtacaagaaaaacctatgtagactntgtagacggcgattcaccatctccagagacaacgaccaagattcactgtatttganaaatgaaacagacctaggagagggacgaggacacgggccgtagttaattnttagttggacgacggagagttgaaagtaggtacgtaactctaacaaggtacgcgtaagggttggtagtgatttgg

SEQ ID NO: 371543 - DNA, 530 bp, Homo sapiens
  misc_feature: GZ8MTXP02HNRAC.15.67.G01.1.454.CMB.2.raw
  modified_base (495)..(495): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctgggagtgggtggccaacataaaacaaagacggaaagtcaagaaaaacctatgtggactctgtgacggccgaattcaccatctccagagacaacgccaaagaattcactgtatttgacaaatgaaacagcctgagaggcgaggacacggcgtgtacttatgtgcgcgagntgatagagactcacaagtagcaggtgtatggattg

SEQ ID NO: 371544 - DNA, 567 bp, Homo sapiens
  misc_feature: GZ8MTXP02FZKS4.15.67.G01.1.454.CMB.2.raw
  modified_base (345)..(345): a, c, t, g, unknown or other
  modified_base (545)..(545): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggaggcttggtccaggccggggggtccctgagactctcctgtgcagtctctggattcacccttagaagttattggatgaccgtgggtccgccaggctccgaggggagggctgggagtgggtggaccaanaataaacgaaagacggaagtacaaagaaaaacctagtgtaggactctgtacgacggcgattcaccatcaccagagacaacgcaaagattcactgttatttgacaaaatgaaacagacccgtagaaggagggacggaagggaaccgaccgggccgttaggttaattagttgtgccggacgagatgaatagtacgactctanaagtgataggtgtatgatttcg

SEQ ID NO: 371545 - DNA, 547 bp, Homo sapiens
  misc_feature: GZ8MTXP02F8CKM.15.67.G01.1.454.CMB.2.raw
  modified_base (346)..(346): a, c, t, g, unknown or other
  modified_base (378)..(378): a, c, t, g, unknown or other
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggcccgggggggtccctggagactctcctgtgcagtctctggattcacccttagaagttattggatgacctgggtccgccaggctccaggggaagggctggagtgggtggccaaanataaaacaaagacggaagtcaagaaaaacctntgtgactctgtagacggcattcaccatctccagagacaacgcaagaatcactgtatttgacaaatgaaacagacctgagaggacggagaccgacggccgtgtattatagtgcgtcgagatgaagtagtacgactntaacaagtacgactaggtaggtataggatttacg

SEQ ID NO: 371546 - DNA, 539 bp, Homo sapiens
  misc_feature: GZ8MTXP02GLE6V.15.67.G01.1.454.CMB.2.raw
  modified_base (341)..(341): a, c, t, g, unknown or other
  modified_base (451)..(451): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccgccaggctccaggggaaggggctggagtgggtggccaanataaaacaaagacggaagtcaagaaaaacctatgtaggactctgtagacggccgattcaccatctccagagacaacgccaaagaattcactgtatttgacaaatgaaacngcctgagaggcgaggaccacggccgtagtattagttgtgcgcgagatgatagtagactctaacaagtagacgagggtagtatggattg

SEQ ID NO: 371547 - DNA, 573 bp, Homo sapiens
  misc_feature: GZ8MTXP02HB2K6.15.67.G01.1.454.CMB.2.raw
  modified_base (313)..(313): a, c, t, g, unknown or other
  modified_base (365)..(365): a, c, t, g, unknown or other
  modified_base (404)..(404): a, c, t, g, unknown or other
  modified_base (442)..(442): a, c, t, g, unknown or other
  modified_base (455)..(455): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtagttatttagaaggtgtcagtgtgaggtgcacttggtggagtcgtgggggaggcttggtccaggccgggggggtcctgagactctcctgtgcagtctctggatcaccttagagttatggatgacctggtccgcaggcctcgaggggaggngtggagtgggtgccaaacaataaaacaaagacgaatacgaaagaaaacctangtaggactctgacgacggcgtatccacactctaccaganaccaaaccgacgaaacgtaattccattaggtatttaanaactaaatcgaanacgacgagaggacggacggacggacgacggtacgtagttagttagtagtcgcgacgagagtagtagtacgtacgtacgtacgtacgtaagtacgtacggtaggtaggtagtagtagtg

SEQ ID NO: 371548 - DNA, 588 bp, Homo sapiens
  misc_feature: GZ8MTXP02IACVD.15.67.G01.1.454.CMB.2.raw
  modified_base (348)..(348): a, c, t, g, unknown or other
  modified_base (488)..(488): a, c, t, g, unknown or other
  modified_base (580)..(580): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgcacgttgggtggaggtcgtgggggaggtcgttggtccgagggccggggggtccctgagactctcctgtgcagtctctggattcacccttagaagttatggatgacctgggtccgccaggctccgaggggagggctggagtgggtggccaaanataaaacgaaagacggaaaagtcaaagaaaaaaccctagtagtaggaactcgttaggtacggaaccggccgtaatttccaaccctatcccgtaccagacgacaaacgccaaagaaatcactgtatttgacaatagaaacngcctggagaggacgaggacgacggcgtagtatttatgtgccgcgaagtgtagtaatacgtaagcttactacgaagttagcgtaggtggttanggtactgg

SEQ ID NO: 371549 - DNA, 537 bp, Homo sapiens
  misc_feature: GZ8MTXP02GTFY4.15.67.G01.1.454.CMB.2.raw
  modified_base (339)..(339): a, c, t, g, unknown or other
  modified_base (407)..(407): a, c, t, g, unknown or other
  modified_base (475)..(475): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctcaggggaagggctggagtgggtgccaanataaacaaagacggaagtcaagaaaaacctatgtggactctgtgacggccgattcaccatctccaganacaacgcaagatcactgtattgacaaatagaaacagcctgagaggcgaggaccgacggccgtgtattntagtgcgacgagagtgagtagtagacgtctacgaagtagacgagggtagtagtggtattcgg

SEQ ID NO: 371550 - DNA, 538 bp, Homo sapiens
  misc_feature: GZ8MTXP02JUSO1.15.67.G01.1.454.CMB.2.raw
  modified_base (345)..(345): a, c, t, g, unknown or other
  modified_base (416)..(416): a, c, t, g, unknown or other
  modified_base (422)..(422): a, c, t, g, unknown or other
  modified_base (494)..(494): a, c, t, g, unknown or other
  modified_base (498)..(498): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagaagttattggatgacctgggtccgccaggctccgaggggaaggggctggagtggggtgccaanataaacaaagacggaagtcaagaaaaacctatgtggactctggtagacggccgattccaccatctccaganacaacnccaagaattcatcgtatttgacaaatgaaacagcctgagaggcggaggacacggccgtgtattagtgtgcgngagntgatacgtagactcactaagagcgtagggtgtagtgattg

SEQ ID NO: 371551 - DNA, 540 bp, Homo sapiens
  misc_feature: GZ8MTXP02FXAXB.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaaggggctggagtgggtggccaaacataaacaaagacggaagtacaagaaaaacctatgtaggactctgtgacgggccgattcaccatctccagagacaacgcaagaattcactgtatttagcaaaatgaaacagcctagagaggacgaggacacggccgtgtattagtgtgcgacgagatgatagtacgactcgtacaagtagacgtaggtgtatgattg

SEQ ID NO: 371552 - DNA, 532 bp, Homo sapiens
  misc_feature: GZ8MTXP02H21E5.15.67.G01.1.454.CMB.2.raw
  modified_base (492)..(492): a, c, t, g, unknown or other
  modified_base (505)..(505): a, c, t, g, unknown or other
  modified_base (510)..(510): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggcttggtccaggccgggggggtccctgagactctcctgtgcagtctctggattcacccttagaagttatggatgacctgggtccgccaggctccgaggggaaggggctggagtgggtggccaaacataaacaaagacggaagtcaagaaaaacctagtgtggactctgtgacggccatcaccatctccagagacaacgccaagattcactgtatttgacaaatgaacagcctgagaggcgaggacacggcctgtattagtgtagcgcgagntgatagtagactntaacngtagcgtaggtaggtatgattg

SEQ ID NO: 371553 - DNA, 616 bp, Homo sapiens
  misc_feature: GZ8MTXP02G52RD.15.67.G01.1.454.CMB.2.raw
  modified_base (377)..(377): a, c, t, g, unknown or other
  modified_base (385)..(385): a, c, t, g, unknown or other
  modified_base (457)..(457): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctggtccgccaggctccgaggggaggggctgggagtggggtggccaacgataaacaaagacggaagtcaagaaaaacctagngtggactntgtagacgggcgattccacctatctccagaacgacaacgaccaagattacactgtatttgacaaatgaaacngacctaggaagacgggacggaaggaccgaccgggtaccggtagttaacgttagttgggtcgacgggtacggaaggtagtaggaagttaaggtacgtaacgttacgtaacgtaagggtaaggtaccggtagggggttaggtattacggggtaattttcgg

SEQ ID NO: 371554 - DNA, 535 bp, Homo sapiens
  misc_feature: GZ8MTXP02HEDZ6.15.67.G01.1.454.CMB.2.raw
  modified_base (306)..(306): a, c, t, g, unknown or other
  modified_base (371)..(371): a, c, t, g, unknown or other
  modified_base (448)..(448): a, c, t, g, unknown or other
  modified_base (485)..(485): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggagactctcctgtgcagtctctggattcacccttagaagttatggatgacctgggtccncaggctccagggaagggctggagtgggtgcaacataaacaaagacggaagtcaagaaaaacctanagtaggactctgtagacggccgattcaccatctccagagacaacgccaagaatcactgtatttgacaaatgaaacanacctgagaggcgaggacacggccgtgtattatagtgngcgagatgatagtacgactctaacaagtagcgaaggtggtatacgtattg

SEQ ID NO: 371555 - DNA, 789 bp, Homo sapiens
  misc_feature: GZ8MTXP02H32C8.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagagactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaaggggctggagtgggtggaccaaacataaaacaaagacggaaagtacaaggaaaaacctataggtagggaacttcgtaggttacggaaccggggtcccgaagtttccaccctaattccctacccaaggaacgaaccaaaaccggacccaaaaggaaactttaccaaacctttaggttaaactttttacggaaacctaaaagttacggaaaaacctaacgggtaccccgttaagggaagggaaacgggggaccgggaaacgggggaaacccgaaacccgggggtccccgggtttaagggttaaacgtttttaacgtttggggttacggggaccggttaccgggaaaaggtaagttacgggtaaaacgtttaaagggttaaacggaaccctttaccgtttaaaaccgaaggtttaaacgggaaccgttaaagggggttacgggtttaaaacttcggggtaaaacttttcggg

SEQ ID NO: 371556 - DNA, 552 bp, Homo sapiens
  misc_feature: GZ8MTXP02I9RU2.15.67.G01.1.454.CMB.2.raw
  modified_base (374)..(374): a, c, t, g, unknown or other
  modified_base (386)..(386): a, c, t, g, unknown or other
  modified_base (433)..(433): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctggggtccgccaggctccgaggggaaggggctggagtggggtggccaacataaacaaagacggaagtcaagaaaacctntgtgactctgtnacggccgattcaccatctccagagacaacgaccaaagaattcaactntatttgacaaatgaaacagcctagagacgggcgaaggacacgggccgtggtaattagttgtgcggacggagaagtgaagtagtacgactctaacgaagtagacgaggtggtatgtattg

SEQ ID NO: 371557 - DNA, 592 bp, Homo sapiens
  misc_feature: GZ8MTXP02JIMLC.15.67.G01.1.454.CMB.2.raw
  modified_base (304)..(304): a, c, t, g, unknown or other
  modified_base (381)..(381): a, c, t, g, unknown or other
  modified_base (391)..(391): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcaccttagaagttatggatgacctgggtccnccaggcctccgaggggagggctggaggtgggtggaccaaacgaataaaacaaaggacggaagtacaagaaaaacctnagtggactcngtgacggcattcacatctaccagacacaaacgaccaaagaattcactagttatttagactaaatgaaaacacgacctaggaggaacgggacgggaaacggaccgacgggtaccgttagttaattagtttggtcgccggacgagaatacggataaggtacgtactctaacgaagtacgacgtagggtggtatgtaacgtttg

SEQ ID NO: 371558 - DNA, 590 bp, Homo sapiens
  misc_feature: GZ8MTXP02F2A0J.15.67.G01.1.454.CMB.2.raw
  modified_base (567)..(567): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgaccgtgggtccgccaggctccgaggggaaggggctgggaggtggggtggccaaacataaaacgaaaagaacggaagtacaaagaaaaaaccctataggtaggaactcgtaggtacgaaccggggcccgtaatttccaacccatcctacccaagaacgaacaaaccggacccaaagaattacactgttatttgacaaaatgaaacagcctaggagaggacgaacgacgacggccgtagtattagttgtgcgcgagatgaatacgtagactctanaagtagcgaggtggtatggattg

SEQ ID NO: 371559 - DNA, 562 bp, Homo sapiens
  misc_feature: GZ8MTXP02HJSAI.15.67.G01.1.454.CMB.2.raw
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccggggggtccctgagactctcctgtgcagtctctggattcacccttagaagttatggatgacctgggtccgccaggctccgaggggaaggggctgggaggtggggtggccaaacataaaacgaaagaacggaagtacaagaaaaacctatgtggactctgtagacggccgattccaccatctaccagagacaacgccaaagattcactgtatttgacaaatgaaacagacctggaagagggacggaaggacgaacgggccgtagtatttagttggtgacggcgaggntagaagtagtacgacttcgacaagtagacgagggtgtatgtatg

SEQ ID NO: 371560 - DNA, 547 bp, Homo sapiens
  misc_feature: GZ8MTXP02IW0PX.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggaggtgggtggccaacataaacaaagacggaagtacaagaaaaacctagtgtggactctgtgacgggcgattcaccatctccagagacaacgccaaagaattcactgtatttgacaaatgaaacagcctaggagagggcggaaggacgacgggccgtgtaattagttgtgcgtcgagatcgatagtagactctacaagtagcgaggtggtatgattg

SEQ ID NO: 371561 - DNA, 580 bp, Homo sapiens
  misc_feature: GZ8MTXP02JEML4.15.67.G01.1.454.CMB.2.raw
  modified_base (350)..(350): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccggggggggtccctggagactctcctgtgcagtctctggattcacccttagaagttattggatgacctgggtcccgccaggctccaggggaaggggctgggagtggggtggccaanataaaacaaagacggaagtacaaagaaaaaacctatagtagggaacttctaggtacggacggggccgaatttccaaccatcctacccaagaacgaaccaaacgacccaaagaattcaactgtatttgacaaatgaaacagcctagagaggcggaggacacgggacgtgtattagttgtgcgtcgagatgaatagtacgactacacaagtagcgagggtgtatggacttgg

SEQ ID NO: 371562 - DNA, 542 bp, Homo sapiens
  misc_feature: GZ8MTXP02HQUX8.15.67.G01.1.454.CMB.2.raw
  modified_base (305)..(305): a, c, t, g, unknown or other
  modified_base (535)..(535): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcttggtccaggccgggggggtccctgagactctcctgtgcagtctctggattcaccccttagaagttattggatgacctgggtccnccaggctccaggggaaggggctgggagtggggtggccaacataaaacaaagaacggaagtcaagaaaaacctatgtggactctgtgacggccgattcaccatctccagagacaacgccaaagaattcactgtatttgacaaatgaaatagacctgagaggcgaggactacggccgtagtattatgtgcgacgagatgatacgagacctatacaagtagacgaggtagtangtattcg

SEQ ID NO: 371563 - DNA, 570 bp, Homo sapiens
  misc_feature: GZ8MTXP02GYXIM.15.67.G01.1.454.CMB.2.raw
  modified_base (201)..(201): a, c, t, g, unknown or other
  modified_base (545)..(545): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatccctcctgtctgtatctgtagganacagagtcaccatcacgttggccgggacaagtcaggactattagaactgacttaggttgtatcagacaagaaacgtaccgggaaacgcccctaagcctccgtgactcgtgtgctgacactacctaactttaacgaaaggtcggggtacccaatacgaagttcgagcggacaggtggtatcgtcggacactagtactttcaacctcctacaccgatcacgcacgcctgacgacgccgtagaagttacttacgtactaaactttattacgacttacaactaagtacttaactaacgttcctacggtacgtcgacggtacggaaacaggtacgaaactcgaaaacgngtacgacggtcagacctactattcg

SEQ ID NO: 371564 - DNA, 530 bp, Homo sapiens
  misc_feature: GZ8MTXP02GYYHQ.15.67.G01.1.454.CMB.2.raw
  modified_base (508)..(508): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctggagtgggtggccaacataaacaaagacggaagtcaagaaaaacctatgtggactctgtgacggccgattcaccatctccagagacaacgccaagaatcactgtatttgacaaatgaaacagcctgagaggcgaggacacggcgtgtattattgtgcgtcgagatgatacgtagactctanaagtagcgaggtgtatgattcg

SEQ ID NO: 371565 - DNA, 530 bp, Homo sapiens
  misc_feature: GZ8MTXP02JDV90.15.67.G01.1.454.CMB.2.raw
  modified_base (448)..(448): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtggggtggccaacataaacaaagacggaagtcaagaaaaacctatgtggactctgtgacggcgattcaccatctccagagacaacgccaaagattcactgtatttgacaaatgaaacngcctgagaggcgaggacacggcctggtattatgtgcgacgagatgataggtagactctacaagtagacagggtgtatgattg

SEQ ID NO: 371566 - DNA, 626 bp, Homo sapiens
  misc_feature: GZ8MTXP02JKLN5.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgaggcccgggggggtccctggagactctcctgtgcagtctctggattcacccttagaagttattggatgacctgggtccgccgaggctccgaggggaaggggcgtgggaggtggggtggacccaaacaataaaacaaaggaacggaaagtacaaagaaaaaacctgtagtaggaactcgtagtagaccgggcctaattccgaacctactcctaccagaacgaaccaaacgacccaaagaattaccacttgtaatttgtaacaaatacgaaacagaccgtagagaggacggaggaaccgacggaccggtagtattacgttgtgcggtacggagagtcggtaataaggttaacgacttaacgtacgtaaggtagacgtagggtagtagtgtaatttcgg

SEQ ID NO: 371567 - DNA, 567 bp, Homo sapiens
  misc_feature: GZ8MTXP02JAEK9.15.67.G01.1.454.CMB.2.raw
  modified_base (382)..(382): a, c, t, g, unknown or other
  modified_base (466)..(466): a, c, t, g, unknown or other
  modified_base (504)..(504): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggggctgagctgggttttccttgttgttatttttagaaggtgtccagtgtgaggtgcacttggtggagtcgtgggggaggcttgggtccaggcccgggggggtccctggagactctcctgtgcagtctctggattcacccttagaagttattggatgacctgggtccgccaggcctccgaggggaaggggctggagtgggtggccaaacataaacaaagacgaagtcaagaaaaaccctngtgactctgtgacggccgattccacatcctccagaacgacaaaccggtcaaacgaattcaactgtatttagacaaatcgaaacngcgtggagaggacgagacgacggtcgtagtattagtgngcgacgagatacgagtacgtacgactactaagaagtacgacgtaggtagttacgtagtacgtg

SEQ ID NO: 371568 - DNA, 538 bp, Homo sapiens
  misc_feature: GZ8MTXP02JKG58.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccccttagaagttattggatgacctgggtccgccaggctccaggggaaggggctggagtggggtggccaaacgataaacaaagacggaagtcagaaaaaacctatgtggactctgtgacggccgattcaccatctccagagacaaacgccaaagaattcactgtatttgacaaatgaaacagcctgagaggcgaggacacggccgtagtattattgtgcgacgagatgatagtagactctacaagtagcaggtggtatggtatg

SEQ ID NO: 371569 - DNA, 648 bp, Homo sapiens
  misc_feature: GZ8MTXP02HWA3X.15.67.G01.1.454.CMB.2.raw
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtgggagtcgtgggggaggcgttggtccgagggcccgggggggtccctggacgactctcctggtgcagtctctggattcacccttagaagttattggatgaccgtgggtcccgcaggcctccgaggggaaggggcgtgggaggtggggtggaccaaaacgaataaaacgaaaaggaaccggaaagtacaaaagaaaaacctagtggtaggactcgtggtacgaccgggccgtaacttccaccctattccacaggaacacaaaccgaccaaagaacttaccattagttaatttgaactaaaatacgaaaacncggtacctaggaagggacggacgggaacgggaccaacggggtccgtaggttagtttagttggtacgcggacggagtagtagtagtaacgtacgacttactagaaggttagacggtaggtaggtactgttagttcg

SEQ ID NO: 371570 - DNA, 533 bp, Homo sapiens
  misc_feature: GZ8MTXP02I8PTK.15.67.G01.1.454.CMB.2.raw
  modified_base (406)..(406): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaggggctggagtgggtggccaaacataaaacaaagacggaagtacaagaaaaacctatgtggactctgtgacggccgattcaccatcncagagacaacgccaaagattcaactgtatttgacaaatgaaacagcctagagaggcgaggacacggcgtgtattatgtgcgcgagatgaatacgtagactctacgaagtagacaggtgtatggattg

SEQ ID NO: 371571 - DNA, 543 bp, Homo sapiens
  misc_feature: GZ8MTXP02FUCGS.15.67.G01.1.454.CMB.2.raw
  modified_base (377)..(377): a, c, t, g, unknown or other
  modified_base (425)..(425): a, c, t, g, unknown or other
  modified_base (441)..(441): a, c, t, g, unknown or other
  modified_base (496)..(496): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggtttcctgtgttatttagaaggtgtccagtgtgaggtgcacttggtggagtctgggggaggcttggtccaggccgggggggtccctggagactctcctgtgcagtctctggattcaccctagaagttattggatgacctgggtccgccagctccgaggggagggctgggagtgggtggccaacataaaacaaagacggaagtacaagaaaaaccctataggngactctgtacgacggccgattcaccatctccagagacaacgaccaaanaattcactgtattganaatagacagcctgagaggacgagacgacgacgtgtattagttagtgcgcgagagngagtagtagtactctacgtaagtagacgaggtaggtagtaggtagtg

SEQ ID NO: 371572 - DNA, 539 bp, Homo sapiens
  misc_feature: GZ8MTXP02GDNFN.15.67.G01.1.454.CMB.2.raw
  modified_base (373)..(373): a, c, t, g, unknown or other
  modified_base (383)..(383): a, c, t, g, unknown or other
  modified_base (442)..(442): a, c, t, g, unknown or other
  modified_base (496)..(496): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggcccgggggggtccctggagactctcctgtgcagtctctggattcacccttagagttattggatgacctggtccgccaggctccaggggagggctggagtgggtggccaacataaacaaaggacgaagtcaagaaaaacctnagtggactcngtgacggccgattccaccatctccagacacaacgcaagaatcactgttattgacaaatnaaacagcctgagaggacgaggacgacggccgtgtacttagttagtgcgacgganagtgatacgtagactactacaaggtacgagaggtgtatgattg

SEQ ID NO: 371573 - DNA, 560 bp, Homo sapiens
  misc_feature: GZ8MTXP02G2HRO.15.67.G01.1.454.CMB.2.raw
  modified_base (528)..(528): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaggggctggagtggggtggccaacataaacaaagacggaagtacaagaaaaacctagtagtaggactctgtagacggccgattccgacctatcctaccagaagaccaaacgaccaaagaaacttcactgtatttgacaaatagaaacagcctagagaggcgaaggacacggcgtagtattagtgtgcgtacgagatgatagtagactntaacgaagtagacgtaggtaggtatgagtttg

SEQ ID NO: 371574 - DNA, 563 bp, Homo sapiens
  misc_feature: GZ8MTXP02GW2AD.15.67.G01.1.454.CMB.2.raw
  modified_base (413)..(413): a, c, t, g, unknown or other
  modified_base (416)..(416): a, c, t, g, unknown or other
  modified_base (421)..(421): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggattcaccttagaagttatggatgacctgggtccgccaggctccgaggggagggctggagtgggtggaccaacaataaaacgaaagacggaagtacaaagaaaaacctgtagtaggactcgtgtagaccggccgattcaccntcncaganacaacgcaagatcactgtatttgacaaatgaaacagcctggagaggcggaggacgacggccgtagtagttagttgtgcggtacgagagtgaataggtacgacttactaacgaaggtacgacgtaggttggtaagtcgtattg

SEQ ID NO: 371575 - DNA, 601 bp, Homo sapiens
  misc_feature: GZ8MTXP02GZYMO.15.67.G01.1.454.CMB.2.raw
  modified_base (431)..(431): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggagtcgtgggggaggcttggtccgaggccgggggggtcctgagactctcctgtgcagtctctggattcacccttagaagttattggatgaccgtgggtccgccaggctccgaggggaggggcgtggaggtgggtggaccaaacaataaaacaaaggaaccggaaagtacgaaagaaaaacctataggtaggactcgtggtagacgggccgattcaccatctccaganacaaacgacaagaactcactagttacttagacaaatagaaacagacctggaagagggacggaacggaacgaccgggtacgttagttaagtttagttggtacggccggacgaaggatcggaattaaggtagaactctaacgaagtagacgtacggtggtatagtagtttgg

SEQ ID NO: 371576 - DNA, 538 bp, Homo sapiens
  misc_feature: GZ8MTXP02FRC7C.15.67.G01.1.454.CMB.2.raw
  modified_base (515)..(515): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtggggtggccaacataaacaaagacggaagtcagaaaaacctatgtggactctgtgacgggccgattcaccatctccagagacaaacgccaaagaattcactgtatttgacaaaatgaaacagcctagagaggacgaggacacgggcgtgtattagttgtgcgcgagatgatagtagactctaanaagtagcgaggtggtatgattcg

SEQ ID NO: 371577 - DNA, 534 bp, Homo sapiens
  misc_feature: GZ8MTXP02FJSQT.15.67.G01.1.454.CMB.2.raw
  modified_base (376)..(376): a, c, t, g, unknown or other
  modified_base (407)..(407): a, c, t, g, unknown or other
  modified_base (488)..(488): a, c, t, g, unknown or other
  modified_base (494)..(494): a, c, t, g, unknown or other
  modified_base (509)..(509): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagagttattggatgacctgggtccgccaggctccaggggaaggggctggagtgggtggccaaacataaaacaaagacgaagtcaagaaaaacctatgngactctgtgacggccgattcaccatctccanagacaaacgccaaagattcactgtaatttgcaaaatgaaacagcctgagaggacgagaccgacggccgtagtatattgtgngcgagntaggatagtgaactntaacaagtaagcaggtggtatgatg

SEQ ID NO: 371578 - DNA, 588 bp, Homo sapiens
  misc_feature: GZ8MTXP02F88V5.15.67.G01.1.454.CMB.2.raw
  modified_base (569)..(569): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccggggggtccctgagactctcctgtgcagtctcgtggattccacccttagtaagttattggatcgaccgtgggtcccgccgaggcctccgaggggaagggcgtgggaggtggggtcggaccaaacgaataaaacgaaaaggacggaaagtacgaaagaaaaacctagtggtaggacttcgtaggtacggaccgggccgattccaccattccaccaagaacgaacaaccgaccaaagtacttacactgttatttgactaaatgaaacagcctagagaggacgaggaccgacggcgtgtattagtcgtgcgagagatgataggtacactcacaagtacgngtaggtgtacgtgactttg

SEQ ID NO: 371579 - DNA, 742 bp, Homo sapiens
  misc_feature: GZ8MTXP02H0SQE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggccgggggggtccctgagactctcctgtgcagtctctggattcacccttagaagttattggatgacctggggtcccgccaggcctccgaggggaaggggcgtgggaggtggggtggacccaaacaataaaacgaaaaggaaccggaaagtacaaagtaaaaaacctagttggtaggactcgtggttacggacgggccgtaatttacccaccctagttcctaccaaggaacgaaaccaaacccggacccaaaagtaaactttaccctaaacgttacggttaattttacggaacctaaaagttacgaaaacctacggtaccccgttagggaagggaacggggacgggaacggggaaccgaacccgggggtacccggtttaggtaaacttttaagtttcgggttacggaccgggtacggtaaggttaagtacggtaaagttaaaggttacggtaaacctttccgtaaacgaaggttaacgacggtaggggttaggttaagttggttaacgtttcgg

SEQ ID NO: 371580 - DNA, 593 bp, Homo sapiens
  misc_feature: GZ8MTXP02GEL0N.15.67.G01.1.454.CMB.2.raw
  modified_base (344)..(344): a, c, t, g, unknown or other
  modified_base (376)..(376): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccggggggggtccctgagactctcctgtgcagtctctggattcacccttagaagttattggatgacctgggtccgccaggctccaggggagggctggagtgggtggccaanataaacgaaagacggaagtcaagaaaaacctntgtgactctgtgacggcgattcaccatctcagacgacaacgacaagattcactgtatttagacaaatagaaacagccgtagaggacgggacggaaggaccgacggggtacccgtaggttaattagttaggtcgcggtacggaggataggaacgttaggtaacggtacctacgttaacaaggttacggacgtaaggggttaggtatggtaacgtttgg

SEQ ID NO: 371581 - DNA, 633 bp, Homo sapiens
  misc_feature: GZ8MTXP02F4WNV.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgttgggttttccttgttgttattttagaaggtgtccagtgtggaggtgctacgttgggtggagtcggtgggggaggtcgtttcgggtccgacggggtcccgggggggttccctggacgaccttcctccgtgtgcagtctcgtggattccacccttagaagttatggatgacctggtccgccaggctccgaggggaagggctgggagtggggtggaccaaacataaaacgaaaggacggaagtacaaagaaaaacctagtagtaggactcgtagtagaccgggccgattcaccatctaccaagaagacaacgaccaaagaacttcgaactgtatttgaactaaatagaaactagaccgtaggagacgggacgaagggaccacgggccgttagtaattagttagtcgacgacgtagataggtaataagtacgtaaacgtccaaacgtaaggtaacgcgtaaggtggttacgtagtaacgtttgg

SEQ ID NO: 371582 - DNA, 526 bp, Homo sapiens
  misc_feature: GZ8MTXP02HREZZ.15.67.G01.1.454.CMB.2.raw
  modified_base (383)..(383): a, c, t, g, unknown or other
  modified_base (410)..(410): a, c, t, g, unknown or other
  modified_base (479)..(479): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccgccaggctccaggggaggggctggagtgggtggccaacataaacaaaagacggaaagtcaagaaaaacctatagtggactntgtgacggccgattcaccatctcaganacaacgcaaagattcactgtatttgacaaatgaaacagcctgagaggcgagacacggcgtgtattatgngcgcgagatgatagtagactctacaagtagacgtaggtgtatgattg

SEQ ID NO: 371583 - DNA, 538 bp, Homo sapiens
  misc_feature: GZ8MTXP02G9T38.15.67.G01.1.454.CMB.2.raw
  modified_base (339)..(339): a, c, t, g, unknown or other
  modified_base (439)..(439): a, c, t, g, unknown or other
  modified_base (484)..(484): a, c, t, g, unknown or other
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgaactgggttttccttgttgttattttagaaggtgtccagtgtgaggtgcacttggtggagtctgggggaggcttggtccaggccggggggtccctgagactctcctgtgcagtctctggattcacccttagaagttattggatgacctgggtccgccaggctccgagggaggggctggagtgggtgccaanataaacaaagacggaaagtacaaagaaaaactatgtaggactctgtagaacgcgattcaccatctcagagacaacgcaagatcactgtattgacaaatanaacagcctagagaggacgaggacgacggcgtgtattagtgtgcgngagatagatagagtactacanagtaagacgtagggtagtatagtacgtgtttcg

SEQ ID NO: 371584 - DNA, 545 bp, Homo sapiens
  misc_feature: GZ8MTXP02GI6F1.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttatggatgacctggtccgcaggctccaggggagggctggagtgggtggccaacataaaacaaagacggaagtacaagaaaaacctatgtaggactctgtgacggccgattcaccatctccagagacaacgaccaaagaacttcactgtatttgacaaatgaaacagacctgacgaggacggagacgacggcgtagtattagtgtgcgacgagagtcgatagtagactcgtaacgaagtacgacgtaggtgtatgtagttgg

SEQ ID NO: 371585 - DNA, 580 bp, Homo sapiens
  misc_feature: GZ8MTXP02GHFW9.15.67.G01.1.454.CMB.2.raw
  modified_base (346)..(346): a, c, t, g, unknown or other
  modified_base (378)..(378): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggaggtgggtggccaanataaaacaaagacggaagtcaagaaaaacctntgtaggactctgtgacgcgatcaccatctcagagacaacgaccaaagaatcactagtatttgacaaatgaaacagacctaggacgaggacggaaggacgacgggccgtagtacttattggtcgcgtcggaagtatagaagttaggtaacgtaccttctaacgaagttacggacgtaggggttggtagtaggtaacgtttcgg

SEQ ID NO: 371586 - DNA, 627 bp, Homo sapiens
  misc_feature: GZ8MTXP02GA6BE.15.67.G01.1.454.CMB.2.raw
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggagtcgtgggggaggtcgttggtccgagggcccggggggtccctggacgacctctcctgtgcagtctcgtggattcacccttagaagttagttggatcgaccgtgggtcccgccgaggcctaccgaggggaaggggcgtgggaggtggggtggaccaaacaataaaacgaaaggaacggaaagtacgaaaagaaaaacctagtaggtaggactcgtaggtacgaccggccgtattccaacctatcctacgagacgaacaaccgaccaaagtaattactactgttatttagaactaaaatacgaaacncgtacctaggagacgggacggaaggaccgacgggtccgtagttattagttagtggcgagagagtacgtaatagtacgactgtaacgaagtagtacgtaggtagtagtgtagtttg

SEQ ID NO: 371587 - DNA, 554 bp, Homo sapiens
  misc_feature: GZ8MTXP02F7DXL.15.67.G01.1.454.CMB.2.raw
  modified_base (348)..(348): a, c, t, g, unknown or other
  modified_base (380)..(380): a, c, t, g, unknown or other
  modified_base (389)..(389): a, c, t, g, unknown or other
  modified_base (416)..(416): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttattggatgacctgggtccgccaggctccgaggggaaggggctggaggtggggtggccaaanataaaacaaagacggaagtcaagaaaaacctntgtggactntgtagacggcattcaccatctccaganacaaacgccaaagatcactgtatttgcaaatgaaacagcctgagaggacgaggacgacggccgtggtattagtgtagcgtcgagatgaataggtagaactctaacgaaggttagacgtagggtaggtatggatttcgg

SEQ ID NO: 371588 - DNA, 545 bp, Homo sapiens
  misc_feature: GZ8MTXP02FQYJ4.15.67.G01.1.454.CMB.2.raw
  modified_base (342)..(342): a, c, t, g, unknown or other
  modified_base (494)..(494): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaggggctggagtgggtggccaaanataaaacaaagacggaagtacaagaaaaacctatgtaggactctgtagacgggccgattcaccatctcagagacaacgcaaagattacactgtatttgacaaatgaaacagactggaagaggacggagacacgggcgtagtattatgtgcgngagatgatagtacgactctacaagtacgacgaggtaggtatcggatttcgg

SEQ ID NO: 371589 - DNA, 579 bp, Homo sapiens
  misc_feature: GZ8MTXP02JGNP4.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttatggatgacctgggtccgccaggctccgaggggagggctgggagtgggtggccaacataaacaaagacggaagtacaagaaaaacctatagtaggactcgtgtagtacgggccgattcacctatcctaccagacgacaaacgaccaaagtaatcactgtatttgacaaatacgaaacacgacctaggaagacgggcggaaggtaccgaacgggccgtagtattagttgtgaccggcgagagtagtatagtaacgactactaacgaagtacgacgaggtagtataggactttagg

SEQ ID NO: 371590 - DNA, 591 bp, Homo sapiens
  misc_feature: GZ8MTXP02GXLZV.15.67.G01.1.454.CMB.2.raw
  modified_base (333)..(333): a, c, t, g, unknown or other
  modified_base (486)..(486): a, c, t, g, unknown or other
  modified_base (541)..(541): a, c, t, g, unknown or other
  modified_base (560)..(560): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtcctgagactctcctgtgcagtctctggattctacccctagtaagttattggatgaccgtcggtccggccaggctccgacggggaaggggacgnggaggtgggtgggaccaaacaacgtaaaacaaaaggaaacggaaagtacgaaagaaaaacctaatgtagactctgtgacggcgattcacactctcacaagacaaacgaccctaaagaattacactgttatttgacaaatgaaacagccagganagggacgaagaacgcgggtacccgttggtatttaagtcggtacgcgacgaggtanagtaacttaaggactaacncttaacaagttaacggcgaggtgtatgatcg

SEQ ID NO: 371591 - DNA, 591 bp, Homo sapiens
  misc_feature: GZ8MTXP02GDBVD.15.67.G01.1.454.CMB.2.raw
  modified_base (563)..(563): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttctgttgttatttagaaggtgtcagtgtgaggtgcacttggtggagtcgtgggggaggcttggtccaggccgggggggtccctggagactctcctgtgcagtctctggattcacccttagaagttattggatgacctgggtccgccaggctccgaggggaagggctggagtggggtggacaacgaataaaacgaaaagacggaaagtacaaagaaaaaacctatagtaggaactcgtagtacgacggggccgaattaccaacccattaccacccaaagaacgaaccaaaccgaccaaaagaacttacactgttaatttgacaaaatgaaaccagacctaggagaggacgaggaacacgggctaggtattagttgtcgcgacgagaatgaatagtagaactctaanaagtaaggacgtaggtgtagtagtatcg

SEQ ID NO: 371592 - DNA, 542 bp, Homo sapiens
  misc_feature: GZ8MTXP02JGO6V.15.67.G01.1.454.CMB.2.raw
  modified_base (457)..(457): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaagttattggatgacctggtccgccaggctccaggggaaggggctggagtgggtggccaaacataaaacaaaagacggaaagtacaagaaaaaacctatgtaggactctgtgacggccgaattcaccatctccagagacaaacgccaaagaattcactgtatttgcaaaatgaaanagcctgagaggcgaggacacggcgtgtattagttgtgcgcgagatgatagtacgactctaacaagtaagcgaggtgtatggattg

SEQ ID NO: 371593 - DNA, 584 bp, Homo sapiens
  misc_feature: GZ8MTXP02IETYC.15.67.G01.1.454.CMB.2.raw
  modified_base (369)..(369): a, c, t, g, unknown or other
  modified_base (410)..(410): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagttattggatcgacctgggtccgccaggctccgaggggaggggctgggagtgggtggccaacataaaacaaagacggaatcgaanaaaaacctatgtggactctgtgacggccgattcaccatccncagacgacaacgaccaaagaattacactagttatttagactaaaatgaaacagaccttaggaaggacgggacggaagggaccgaaccggggtaccgttaggtttactttaagttggtcgcggtacgagtatagagtagtacgactactagaagtgacgtaggtgtatgtacttg

SEQ ID NO: 371594 - DNA, 558 bp, Homo sapiens
  misc_feature: GZ8MTXP02F2BNQ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagagttatggatgacctgggtccgccaggctccgagggagggctggagtgggtggccaaacataaaacaaagacggaagtacaagaaaaacctatgtaggactctgtgacgggccgaattccaccatctccagagacaacgccaaagattcactgtatttgacaaaatgaaacagcctaggagagggacgagggaaccacgggccgtgttatagttgtgccgcgagatggataggtacgactctaacgaagtagacgtagggtaggtatagtagttcg

SEQ ID NO: 371595 - DNA, 642 bp, Homo sapiens
  misc_feature: GZ8MTXP02HRBRR.15.67.G01.1.454.CMB.2.raw
  modified_base (609)..(609): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcacccttagaagttattggatgacctgggtccgccaggctccgaggggaaggggctgggaggtggggtcggaccaacaataaaacgaaaaggacgggaaagtacaaaggaaaaaccctagtggtagggacttcgtggttagaaccggggccgtaattccacccgtactcctaccaaggaacgaacccaaacgacccgaaaagtaactttccaacttaggttaattttcggactaaaagttcgaaactagtacccgtaggaggacgggcgaaggaccacgggccgtagttattagtgtagccggacgagtatgtaagttagtacgacttctaacgngtacgacggtagggttggtaatcggtatttagg

SEQ ID NO: 371596 - DNA, 605 bp, Homo sapiens
  misc_feature: GZ8MTXP02GZVBE.15.67.G01.1.454.CMB.2.raw
  modified_base (384)..(384): a, c, t, g, unknown or other
  modified_base (461)..(461): a, c, t, g, unknown or other
  modified_base (555)..(555): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgagggcccgggggggtccctggacgactctcctgtgcagtctctggattcacccttagaagttatggatgacctgggtccgccaggctccaggggaaggggctgggagtgggtggccaaacataaacgaaagacggaagtacaagaaaaaacctntagtggaactcgtagtaggaaccgggccgtaattcgaccctatactccaagacgaacaaaccggaccaaagaattanactgtatttagacaaaagtacgaaactacgcctaggaagacgggacgaacgggaccgtacgggaccgttagtaagttagttgtgccggcgaagnttagagttaggtacacgtctaacgaagtaacgcgtaggtgtatgagtttg

SEQ ID NO: 371597 - DNA, 636 bp, Homo sapiens
  misc_feature: GZ8MTXP02F0YOU.15.67.G01.1.454.CMB.2.raw
  modified_base (438)..(438): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggattcacccttagaagttattggatgacctgggtccgcaggctccgaggggaagggctggagtggggtcggaccaaacaataaaacgaaaaggaaccggaaagtaccaaagaaaaaacctagtgtaggaactctaggtagaccgggccgaattccaccatctaccagaanacaacgaccaaagaacttcactacgttaatttaggacctaaaagtcgaaaacgacgacccttaggaaggacggacgggaacggaaaccgaccgggtccggttagttaatttagttggtcgccggacgtaaggattagaaagttaggtaacgtaacgttctaacgaagtacggacgtagggtaggtaatgtaactttgg

SEQ ID NO: 371598 - DNA, 562 bp, Homo sapiens
  misc_feature: GZ8MTXP02JRQZJ.15.67.G01.1.454.CMB.2.raw
  modified_base (344)..(344): a, c, t, g, unknown or other
  modified_base (376)..(376): a, c, t, g, unknown or other
  modified_base (391)..(391): a, c, t, g, unknown or other
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctgggagtgggtggccaanataaaacaaagacggaagtcaagaaaaacctntgtaggactctggtnacggcgattccacatcctccagacgacaacgaccaaagattcactgtatttgacaaatagaaacaggccctaggaggagggacgaaggacgacggccgtaggtattattgagcgacgagatacgataggtacgactccgtanaagtacgacgaggtagtagtaggtcgtag

SEQ ID NO: 371599 - DNA, 604 bp, Homo sapiens
  misc_feature: GZ8MTXP02IC3B5.15.67.G01.1.454.CMB.2.raw
  modified_base (553)..(553): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtggaggtgcacttgggtggaggtcgtgggggaggcttgggtccgaggcccgggggggtccctggagactctcctgtgcagtctctggattcaccttagaagttatggatgaccgtgggtcccgccaggctcccgaggggaaggggcgtgggaggtggggtggccaaacataaaacaaaggacggaaagtacaagaaaaacctagtaggtggaccttgtggtacggaccgggccgtattccaccctaatcctaccagaacgacaaacgccaaagaattcacgtagttatttgaacaaatagaaacagacctaggagagggcgaaggaccgaacggtccgtagtagtttagttgaggtcgacgagntagtaataggtacgactctaagaagtacgacgagggtgtagtagtagttcg

SEQ ID NO: 371600 - DNA, 626 bp, Homo sapiens
  misc_feature: GZ8MTXP02JE2ZG.15.67.G01.1.454.CMB.2.raw
  modified_base (345)..(345): a, c, t, g, unknown or other
  modified_base (389)..(389): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtgggtggccaaanataaaacaaagacggaagtacaaagaaaaacctatagtgactgngtagacgggccgattccaccatctccagacgacaacgaccaagaattcactagtaatttacgacaaaatcgaaacacgacctaggaaggagggaccggaaggaaccgaccggggtaccgttaggttaatttagttggtacgccggtacggagtagtacgtaaattaacggtaacggtaaccttacgtaacgaacgggtacgacggtaagggggttagtaacggttaggtagtttagg

SEQ ID NO: 371601 - DNA, 659 bp, Homo sapiens
  misc_feature: GZ8MTXP02IQ17P.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcgttggtccgaggcccgggggggtccctggagactctcctgtgcagtctctggattcacccttagaagttattggatgacctgggtccgccaggctccgaggggaaggggctggggaggtggggtggaccaaacaataaaacaaaggacggaaagtacaaagaaaaacctagtagtaggtactctaggtaggaccggggtccgaatttaccaaccctattcctaccgaaagaacgaacaaaccgaccaaaagaatttaccaacttgttaatttagaacctaaaagtacgaaacacgtccgtaggaaggacgggacggaacggaccgtaacgggtccggttagttaaatttagtttggtcgcgacggagtaatggaaacgttaagtaacgaccttacgtaacgtaaggttagacgtagggtaggtaagtacggtaatttgg

SEQ ID NO: 371602 - DNA, 535 bp, Homo sapiens
  misc_feature: GZ8MTXP02G1709.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctggagtgggtggccaacataaaacaaagacggaagtcaagaaaaacctatagtggactctgtgacggcgatcaccatctccagagacaacgaccaagaattcactgtatttgacaaatgaaacagcctgagaggcgaggacacggcgtgtattatgtgcgcgagatggatagtacgactctacaagtacgactaggtagtatgtattcg

SEQ ID NO: 371603 - DNA, 629 bp, Homo sapiens
  misc_feature: GZ8MTXP02H7Q42.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaaggggctgggaggtggggtggacccaaacgaataaaacgaaaaggaacggaagtacaaagaaaaacctagtaggtaggactcgtaggttacggaaccggggcccgtaatttcccgaaccctacttcctacccaagacgaaacaaaccgacccaaagtaaacttccaacttgttaatttacgaactaaatacgaaacagtacccgtaggaggacgggacggaacggaaccgaaccgggccgttagtaatttagtgtagccggacgagatgaataggtacgactctagaagtgacgtagggtgtatgattg

SEQ ID NO: 371604 - DNA, 688 bp, Homo sapiens
  misc_feature: GZ8MTXP02GY6UX.15.67.G01.1.454.CMB.2.raw
  modified_base (359)..(359): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggaggcttggtccgaggccggggggtccctgagacctctcctgtgcagtctctggacttccacccttagaagttattggatgacctcgggtcccgcgacggctccgaggggaggggcgtgggaggtgggtcgggacccaaaanaataaaaacgaaaaggaacgggaaagtaaccaaaagaaaaaacctagtaggtaggtaaccttcgtaggtacggaaccggggccctaaattcccaacccgtatcctacccgaagaacgaaccaaacccggacccaaaagaaacttccaacttggttaatttacggaacctaaaagttacggaaaacacggtaccgtagggaagggacgggacgggaagggaacccgaccggggtccggttaggttaaattcgttaggtcgacggacgtagaatcgaagtaggtacgactacgtaacaagttacggacgaagggtgtaagtgtaactttgg

SEQ ID NO: 371605 - DNA, 574 bp, Homo sapiens
  misc_feature: GZ8MTXP02HY5GV.15.67.G01.1.454.CMB.2.raw
  modified_base (464)..(464): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtgggaggtcgtggggggaggcgttggtccgagggcccgggggggtccctggagactctcctgtgcagtctctggattccacccttagaagttattggatgacctgggtccgccaggctccgaggggaaggggctggagtggggtgccaacataaaacaaagacggaagtacaagaaaaacctatgtaggacttctggttagaccgggccgaattccacccatcctccagagaaccaacgccaaagaattcactgtatttnacaaatgaaacagacctggagaggacggaggacgacggccgttgtattagtgtgcgtacaggatgaatagacgtactctaacgaagtagcgtagggtagtagtgattcgg

SEQ ID NO: 371606 - DNA, 547 bp, Homo sapiens
  misc_feature: GZ8MTXP02IMH5G.15.67.G01.1.454.CMB.2.raw
  modified_base (440)..(440): a, c, t, g, unknown or other
  modified_base (442)..(442): a, c, t, g, unknown or other
  modified_base (445)..(445): a, c, t, g, unknown or other
  modified_base (485)..(485): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaaggtgtccagtgtgaggtgcacttgggtggagtcgtgggggaggcttgggtcccaggccgggggggtccctgagactctcctgtgcagtctctggattcacccttagagttatggatgacctgggtccgccaggctccgaggggaaggggctggagtgggtggccaaacataaacaaagacggaagtacaagaaaacctatgagactctgtagacgggcgattcaccatctccagagacaacgacaaagattcactgtatttananaanagaacagcagagaggcgaagacgcggcgtagtattatcgngcgagagagtagagtagtacgtactactacgtaagtagtacgtaggtaggtacgtagtagtg

SEQ ID NO: 371607 - DNA, 561 bp, Homo sapiens
  misc_feature: GZ8MTXP02GTGBT.15.67.G01.1.454.CMB.2.raw
  modified_base (266)..(266): a, c, t, g, unknown or other
  modified_base (347)..(347): a, c, t, g, unknown or other
  modified_base (380)..(380): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccgaggcccgggggggtccctggagactctcctgtgcngtctctggattcacccttagagttatggatgacctgggtccgccaggctccgaggggaaggggctggagtgggtggccaanaataaacaaagacggaaagtcaagaaaaacctntgtgactctgtgacggccgatcaccatctccagagacaacgccaagaatcactgtatttgacaaatgaaacagacctgacgaggaccggaggaccacggccgtgtaattattgtgcgtacgagataggataggtaacgactacttaacaagttagacgtagggtagtataggtaactttgg

SEQ ID NO: 371608 - DNA, 601 bp, Homo sapiens
  misc_feature: GZ8MTXP02G1PBI.15.67.G01.1.454.CMB.2.raw
  modified_base (315)..(315): a, c, t, g, unknown or other
  modified_base (414)..(414): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggtcgttgggtccgagggcccgggggggtccctggagacttctcctgtgcagtctctggattccacccttagaagttattggatgacctgggtccncaggctccgaggggagggctggagtggtggaccaacaataaacaaagacggaatcaaagaaaaacctgtgtgactctagtgacggcgattccaccatcnccagacgacaacgaccaaagaacttcacttgtactttagactaaatacgaaacagacctaggaagacggacggaaggaccgaacgggccgttagtagttaagttggtcgaccgaggagagtacgaataaggtacgaacttccgtaaacgaaggttagacggtaaggtggtagtacggtaagtttcgg

SEQ ID NO: 371609 - DNA, 554 bp, Homo sapiens
  misc_feature: GZ8MTXP02HCQII.15.67.G01.1.454.CMB.2.raw
  modified_base (303)..(303): a, c, t, g, unknown or other
  modified_base (338)..(338): a, c, t, g, unknown or other
  modified_base (531)..(531): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctggtccncaggctcgaggggagggctggagtgggtggccaanataaaacgaaagaacggaagtacaaagaaaaacctagtgtaggactctagtgaccggccgattccaccatctccagagaacaacgaccaaagatcatgtatttgacaaatgaaactagacctagaaggaggacggaaggacgacgggaccgtaggtaatttagttgtgcgacgagatgaatagacgactacanaagtagacgtaggtgtatgattg

SEQ ID NO: 371610 - DNA, 568 bp, Homo sapiens
  misc_feature: GZ8MTXP02HHK1B.15.67.G01.1.454.CMB.2.raw
  modified_base (307)..(307): a, c, t, g, unknown or other
  modified_base (536)..(536): a, c, t, g, unknown or other
  modified_base (560)..(560): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggattcacccttagaagttatggatgacctgggtccnccaggctccgaggggaagggctgggaggtgggtggccaaacaataaacgaaaagaacggaagtacaagaaaaacctatagtggactctggtagacgggccgattccaccatccaccagacgaacaacgaccaagaattcacttgtatttgacaaatagaacagcctggaagaggcgaggacacggccgtgtatttagtgtgccgtacgagatagtatacgtagtacctntaacgaaggtagacgaggtgtagnggtatttg

SEQ ID NO: 371611 - DNA, 656 bp, Homo sapiens
  misc_feature: GZ8MTXP02GSTO5.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccaggccggggggtccctgagactctcctgtgcagtctctggattcacccttagaagttattggatcgaccgtgggtcccgccgaggcctccgaggggaaggggctgggaggtggggtcggaccaaacgaataaaacgaaaaggaacgggaaagtacgaaaagtaaaaaacccttagtagtaggtactcgtaggtacgaccggggccgtaacttccgaaccctaagtccctaccgaagaacgaacaaaccggaccaaagtaacttacacttgttatttacgactaaatacgaaacacgaccgtagaggaggcggaagaccgacgggtaccgtgttaacttagttggtgtccggacgtaggagtagtaagtaggtaaacgtacgtactaacgtaaggtacgacgtagggtggttacgtaggtacgtttgg

SEQ ID NO: 371612 - DNA, 593 bp, Homo sapiens
  misc_feature: GZ8MTXP02F3X7R.15.67.G01.1.454.CMB.2.raw
  modified_base (561)..(561): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagaagttattggatgacctgggtccgccaggctccgaggggaagggcgtggagtggggtggaccaaacaataaaacgaaaggaacggaagtacaaagaaaaacctataggtaggaactcgtaggtagaccggggccgtaacttccacccatcctacccagaacgaacaaaccgaccaaaagaattacacttgtaatttgacaaaatgaaacaggcctagagacggacggaggaaccgacggccgtagtattattagtgccgagagagttgatagtagactntaacgaagtacgcgtaggtggtaatgaacttg

SEQ ID NO: 371613 - DNA, 622 bp, Homo sapiens
  misc_feature: GZ8MTXP02HFMPY.15.67.G01.1.454.CMB.2.raw
  modified_base (418)..(418): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttattggatgacctggtccgccaggctccaggggaaggggctgggagtggggtggccaacaataaaacaaagaacggaagtacaagaaaaacctatgtaggactctgtgacggccgattcaccatctccaganacaacgcaagaattacactgtatttagactaaatagaaacgagacccgtaggagggaacgggcgggaacggaaaccgaccggggacccgttaggttaactttagtttaggtgacggacgaaggatacgtaataagggttaacgacttacccgtaacgaaggttaaacgacgtaaaggggttaggttagtaggtaacttttcggg

SEQ ID NO: 371614 - DNA, 566 bp, Homo sapiens
  misc_feature: GZ8MTXP02H2EZ7.15.67.G01.1.454.CMB.2.raw
  modified_base (343)..(343): a, c, t, g, unknown or other
  modified_base (480)..(480): a, c, t, g, unknown or other
  modified_base (496)..(496): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctggtccgccaggctccgaggggagggcgtggagtgggtggaccaaanataaaacaaaagacggaaagtacaagaaaaacctatgtaggactcgtagtagaccgggccaattccaccatctccagacgacaaacgccaaagaacttcacttgtatttgactaaatgaaactgaccctgagagggngaggacgacggccgtnattatgtgcgngagatgaagtagtacgacttacaacgtaagtaacgcgtagggtggttatgtacgtttgg

SEQ ID NO: 371615 - DNA, 744 bp, Homo sapiens
  misc_feature: GZ8MTXP02I74PQ.15.67.G01.1.454.CMB.2.raw
  modified_base (304)..(304): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtcctggagactctccgtgtgcagtctctggattccacccttagaagttatggatgacctgggtccncaggctccgagggaagggctggaggtgggtcggaccaacgataaacgaaagacggaagtacaaggtaaaaaaccctgtagtagacttcgtagtacgaccgggcctaaattccgaaccgtatccgtacccgaaggaacgtaaccgaaaccggcccgaaaaggtaactttaccgaaacccgtttagggttaaactttttacggaaccgtaaaaacgttacggtaaaaccgtacggttaccccgttaaggaacggaacgggaccgggtaaaccgggaaccgaccggggtacccgttaggttaactttaacggttcggttacggaccggtccggtaaaagtagttaccggtaaagttaacgggtaacgtaaacccgttaccttaaccggaaggtttaacggaccgttaaaggggtccggttaagttaccggtagtttaaccggg

SEQ ID NO: 371616 - DNA, 598 bp, Homo sapiens
  misc_feature: GZ8MTXP02ITO33.15.67.G01.1.454.CMB.2.raw
  modified_base (371)..(371): a, c, t, g, unknown or other
  modified_base (374)..(374): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggccgccaggctccaggggaagggctggagtggggtgccaaacataaacaaagacggaatacaagaaaacctntgnggactgtgtgacggcgattcaccatctaccagagacaacgaccaaagaacttcactgtatttgaactaaatgaaacacgtcctaggaagagggacgggaggaaccgacgggtccggttagttaactttaacgttggtgacggtacgacggattcggtaaataacgtaggaaccttacgtaaccgtaaggtacggacgtaggggttaggtaactggtaagtttgg

SEQ ID NO: 371617 - DNA, 566 bp, Homo sapiens
  misc_feature: GZ8MTXP02G3SZQ.15.67.G01.1.454.CMB.2.raw
  modified_base (416)..(416): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtcccaggcccgggggggtccctgagactctcctgtgcagtctctggattcacccttagaagttatggatgacctgggtccgccaggctccaggggaagggctggagtgggtggccaacataaacaaagaaccggaagtacaagaaaaacctatgtaggactctgtgacggccgattccaccatctccaganacaacgccaagaattcactgtatttgacaaatagaaacagtcctagagacggacggaggacgacggaccgtagtagttaacgttgtagtccggacgagagtagataagtacggacctataacgaagtaacgcgtaggtgtaatgatttgg

SEQ ID NO: 371618 - DNA, 556 bp, Homo sapiens
  misc_feature: GZ8MTXP02IT8S6.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggaggtggggtggccaacataaacgaaagacggaagtacaagaaaaacctatgtgactctgtgacggccgattcaccatctaccagacgacaacgaccaaagaattacactgttattgacaaaatgaaacagcctaggagaggcgaaggacgacggaccgtgtattattgtagcgacgagagtgaatagtacgactctaacgaagtagacgtaggtggtactgattgg

SEQ ID NO: 371619 - DNA, 583 bp, Homo sapiens
  misc_feature: GZ8MTXP02J0CD8.15.67.G01.1.454.CMB.2.raw
  modified_base (308)..(308): a, c, t, g, unknown or other
  modified_base (345)..(345): a, c, t, g, unknown or other
  modified_base (374)..(374): a, c, t, g, unknown or other
  modified_base (377)..(377): a, c, t, g, unknown or other
  modified_base (384)..(384): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctggagactctcctgtgcagtctctggattcacccttagaagttattggatgacctgggtccnccaggctccgaggggaggggctggagtgggtgccaanataaacaaagacggaatcaagaaaacctntgnggactcngtgacggcgattcaccatctaccagacgacaacgaccaaagattcactagttattgacaaagtgaaacagcctagagagggacggaaggacgaccgggtccgtagtaagtttagtcgtaggccgacggaagagtaggaattaccggtaagtaccttacgaactaaggtaggcgtaggggttaggtacgtagacgtttgg

SEQ ID NO: 371620 - DNA, 539 bp, Homo sapiens
  misc_feature: GZ8MTXP02GRYMP.15.67.G01.1.454.CMB.2.raw
  modified_base (377)..(377): a, c, t, g, unknown or other
  modified_base (449)..(449): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgaccgtgggtccgcaggctccgaggggaggggctgggaggtgggtggaccaacataaacaaagacggaagtcaagaaaacctangtggactctgtgacggcgattcaccatctcagagacaacgccaagaactcactgtatttgacaaatgaaacngcctaggagaggacggaggacacggcgtgtattatgtgcgcgagatagatagtacgactacgtanaagtagacgtaggtgtatgatttgg

SEQ ID NO: 371621 - DNA, 546 bp, Homo sapiens
  misc_feature: GZ8MTXP02GKBYD.15.67.G01.1.454.CMB.2.raw
  modified_base (379)..(379): a, c, t, g, unknown or other
  modified_base (435)..(435): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcacccttagaagttattgggatgacctgggtccgccaggctccgaggggaaggggctgggagtgggtggccaacataaacaaagacggaagtcaagaaaaacctntgtggactctgtgacggccgattcaccatctccagagacaacgcaaagatcacgtntatttgacaaatgaaactagcctagagaggacggaggacacgggcgtagtattagttgtagcgcgagatgatagtagactctaacgaagtagacagggtgtaatcgagttg

SEQ ID NO: 371622 - DNA, 607 bp, Homo sapiens
  misc_feature: GZ8MTXP02IASSP.15.67.G01.1.454.CMB.2.raw
  modified_base (342)..(342): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtgagtcgtgggggaggcttggtccaggccgggggggtccctgagactctcctgtgcagtctctggattccaccttagaagttatggatgacctgggtcccgcaggctccgaggggagggctggaggtgggtggccaaanaataaaacgaaagacggaaagtcaagaaaaacctatggtagacttctaggtacgaccgggccgtattccaaccctattccgaccaagaacgaacaaaccgacccaaagtaacttacacttagttaattttagaactaaaatagaaacagtaccctaggaagagggacggaagaccgaacgggccgttaggtactttagtggtgccgacgagtagagtaagtagtacgtactacgtaacgaagtagacgtaggtgtagtcgtagtg

SEQ ID NO: 371623 - DNA, 604 bp, Homo sapiens
  misc_feature: GZ8MTXP02J1HH3.15.67.G01.1.454.CMB.2.raw
  modified_base (530)..(530): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtggggggaggcttgggtccaggccgggggggtccctgagactctcctgtgcagtctctggattcacccttagaagttattggatgacctgggtccgccaggctccgaggggaaggggctggaggtgggtggccaacataaaacgaaagaaccggaagtacaaagaaaaacctatgtggaactcgtggtaggaccgggccgaattccaccatctacccaaggaacgaacaaaccgacccaaaggtaactttcacttgttattttaggactaaaagtgaaactaggcctaggagagggacgaggacacgggccgtagtattntagtgcgagtagataggatagtacgacctacgttaacgaagttacggcgtaggggttaggtatcggaatttcgg

SEQ ID NO: 371624 - DNA, 543 bp, Homo sapiens
  misc_feature: GZ8MTXP02IHO4A.15.67.G01.1.454.CMB.2.raw
  modified_base (406)..(406): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggtttttccttgttgttattttagaaggtgtccagtgtgaggtgcacttggtggagtctgggggaggcttggtccaggcccggggggggtccctgagactctcctgtgcagtctctggattcacccttagagttatggatgacctgggccgccaggctccaggggaaggggctggagtggggtggccaaacataaacaaagacggaagtacaagaaaaacctatgtaggactctgtgacgggccgattcaccntctccagagacaacgccaagaattcaactgtatttagacaaatgaaacagacctagagaggacgaggacgacggcgtgtattattgtgcgtcgagatcgagtagtagactctacaagtacgcgaggtgatgactttg

SEQ ID NO: 371625 - DNA, 606 bp, Homo sapiens
  misc_feature: GZ8MTXP02GHL7U.15.67.G01.1.454.CMB.2.raw
  modified_base (304)..(304): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccnccaggctccgaggggaaggggctgggagtggggtggccaacataaaacaaagacggaaagtacaagaaaaacctatgtaggaactcgtgtagacggccgattcaccatctaccagagacaacgaccaaagaattcactgtatttagactaaaagtgaaacagacccgtaggaaggagggacggaagggaaccgaccggggtacccgtaggttaacgtttagttaggtcgcggacgaggatgaagtaacgtagaactccgtaacgaaggttacgacgtagggtggtaacgtggtaagtttcgg

SEQ ID NO: 371626 - DNA, 543 bp, Homo sapiens
  misc_feature: GZ8MTXP02FI54G.15.67.G01.1.454.CMB.2.raw
  modified_base (309)..(309): a, c, t, g, unknown or other
  modified_base (381)..(381): a, c, t, g, unknown or other
  modified_base (417)..(417): a, c, t, g, unknown or other
  modified_base (451)..(451): a, c, t, g, unknown or other
  modified_base (521)..(521): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtggggggaggcttgggtccaggccgggggggtccctggagactctcctgtgcagtctctggattcacccttagaagttattggatgacctgggtccncaggctccaggggaaggggctggagtgggtggccaaacataaaacgaaagacggaagtacaagaaaaacctntgtggactctgtgacggcgattcaccatctacaganacaacgaccaagaattcactgtatttgcaaaatnaaacagcctagagaggacgaggaccgacggccgtgtattatgtcgcgcgagatgaatagacgtactctanaagtagcaggtgtatggatttg

SEQ ID NO: 371627 - DNA, 634 bp, Homo sapiens
  misc_feature: GZ8MTXP02FUKNW.15.67.G01.1.454.CMB.2.raw
  modified_base (616)..(616): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttattggatgacctgggtccgccaggctccgaggggaaggggctggaggtggggtggaccaaacaataaaacgaaaagacgggaaagtacaaagaaaaaacctataggtaggactcgtggtacggaccgggcccgattaccacccctaatcctacccaagaacgaaaccaaaccgacccaaaggtaaacttacgaacttaggttaattttagactaaaaagtcgaaaacaagacccgtagaaggaacgggacggaagggaacccgacgggacccgttaggttactttaagttggtagcgacgaggatgaatagtacgactctaacaagtanacgtaggtgtatggattg

SEQ ID NO: 371628 - DNA, 554 bp, Homo sapiens
  misc_feature: GZ8MTXP02IZF47.15.67.G01.1.454.CMB.2.raw
  modified_base (342)..(342): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctggtccgccaggctccaggggaaggggctggagtggggtggccaaanataaaacaaagacggaagtcaagaaaaaacctatgtaggaactctgtgacgggccgaattccaccatctccagacgacaaacgccaaagaattcactgtatttgacaaatgaaacagcctagagaggcgaaggacacgggccgtgtattattgtagcgcgagagtgaaattacggtagactctaacaagttagcgtagggtgtactgatttg

SEQ ID NO: 371629 - DNA, 536 bp, Homo sapiens
  misc_feature: GZ8MTXP02IURCL.15.67.G01.1.454.CMB.2.raw
  modified_base (304)..(304): a, c, t, g, unknown or other
  modified_base (491)..(491): a, c, t, g, unknown or other
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggccgggggggtccctgagactctcctgtgcagtctctggattcacccttagaagttattggatgacctgggtccnccaggcctcgagggaagggctggagtgggtggccaaacgataaaacaaagacggaagtacaagaaaaacctatgtaggactctgtagacggcgattccaccatctcagagacaacgaccaaagaattcactgtatttgacaaatgaaacagcctagagaggcgaggacacggcgtgtaattatgtgngcgagatgaatagagactcaanaagtagcgtaggtgtaatgattg

SEQ ID NO: 371630 - DNA, 562 bp, Homo sapiens
  misc_feature: GZ8MTXP02GMQUD.15.67.G01.1.454.CMB.2.raw
  modified_base (301)..(301): a, c, t, g, unknown or other
  modified_base (338)..(338): a, c, t, g, unknown or other
  modified_base (371)..(371): a, c, t, g, unknown or other
  modified_base (458)..(458): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacctagagttatggatgacctggtccncaggctccgaggggagggctggagtgggtggaccaanataaaacaaagacggaagtacaagaaaaacctntagtggactcgtagtagacgggccgattccaaccatctaccagagacaaacgccaaagaacttcacgtgttatttagactaaaagtnaaacgagcctaggaggaggacggaaggaccgacggacgtgtaattagtgtgcgcgagatgatagtacgactcaacaagtacgacgtaggtgtaatggtacttgg

SEQ ID NO: 371631 - DNA, 532 bp, Homo sapiens
  misc_feature: GZ8MTXP02GT4PE.15.67.G01.1.454.CMB.2.raw
  modified_base (305)..(305): a, c, t, g, unknown or other
  modified_base (493)..(493): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccnccaggctccaggggaaggggctggagtgggtggccaaacataaaacaaagacggaagtcaagaaaaacctatgtggactctgtagacggcgattcaccatctccagagacaacgccaagatcactgtatttgacaaatgaaacagcctagagaggcgaggacacggcgtgtattatgtagcgtcgagntgatagtagactctacaagtagcgtaggtgtatgattcg

SEQ ID NO: 371632 - DNA, 561 bp, Homo sapiens
  misc_feature: GZ8MTXP02G7PNL.15.67.G01.1.454.CMB.2.raw
  modified_base (301)..(301): a, c, t, g, unknown or other
  modified_base (375)..(375): a, c, t, g, unknown or other
  modified_base (418)..(418): a, c, t, g, unknown or other
  modified_base (447)..(447): a, c, t, g, unknown or other
  modified_base (450)..(450): a, c, t, g, unknown or other
  modified_base (453)..(453): a, c, t, g, unknown or other
  modified_base (457)..(457): a, c, t, g, unknown or other
  modified_base (459)..(459): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttatggatgacctggtccnccaggctccagggaagggctggagtggggtggccaaacataaaacaaaagacggaagtacaagaaaaaacctangtaggaactctgtagacgggccaattcaaccatctccagaaanaacaacacaaagaatactatatattatanaanaanaaananacagagagacgagacgacgacgtagtattagttagtgacgacgagagtagtaagtaagtacgtactactaacgtaagtagacgacggtagtagtagtagtag

SEQ ID NO: 371633 - DNA, 576 bp, Homo sapiens
  misc_feature: GZ8MTXP02HGOHF.15.67.G01.1.454.CMB.2.raw
  modified_base (526)..(526): a, c, t, g, unknown or other
  modified_base (550)..(550): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgacctggtccgccaggctccgagggaggggcgtggagtggggtgccaacaataaacaaagacggaaagtacaagaaaaactaatagtaggtactctgtacggaacggccgacgttcaaccactcctaccaacgacgaacaaaccgaccgaaagaacttacacgttagttactttgacaaatagaacagcctagagaaggcgagggaacgacggccgtgtaagttagtcgtgcgnggagagtgagtagtagactactanagtaagcgaggtgaatcgagtgttcg

SEQ ID NO: 371634 - DNA, 594 bp, Homo sapiens
  misc_feature: GZ8MTXP02JJWAX.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtggggtggaccaaacataaaacaaaggaacggaaagtacaagaaaaaacctataggtaggaactcgtaggttacgaccgggccgtaacttccgaaccctattacctacccaagaacgaaccaaaccggacccaaagaacttaccactagtaatttgacaaaatagaaacagcctagagaggacggaggacacggacgtgtattagtgtgcgcgagatgatagtagactctaacaagtacgacgagggtagtatagattcgg

SEQ ID NO: 371635 - DNA, 545 bp, Homo sapiens
  misc_feature: GZ8MTXP02I0CVU.15.67.G01.1.454.CMB.2.raw
  modified_base (301)..(301): a, c, t, g, unknown or other
  modified_base (367)..(367): a, c, t, g, unknown or other
  modified_base (409)..(409): a, c, t, g, unknown or other
  modified_base (454)..(454): a, c, t, g, unknown or other
  modified_base (496)..(496): a, c, t, g, unknown or other
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcgaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacctagaagttatggatgactggtccnccaggctccgaggggagggctggagtgggtgacaacataaacaaagacgaagtcaagaaaaacctntagtggactcgtgtagacgggcctattccaccatcaccaganacaacgccaaagattcaacttgtattagacaaatgaaacagtccngagaggacgaaggaccgacggcgtgtaattgtgtgcgacganatgaatagtacgaacttcaaanaagtacgacgtaggtagtagtgtatcg

SEQ ID NO: 371636 - DNA, 540 bp, Homo sapiens
  misc_feature: GZ8MTXP02HGO2C.15.67.G01.1.454.CMB.2.raw
  modified_base (491)..(491): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggaggtgggtggccaacataaaacaaagacggaagtacaagaaaaacctatgtggactctgtgacggcgattcaccatctccagacgacaacgccaagaattcactgtatttagacaaatgaaacagacctgagaggcgagacacggcgtgtatatgtgcgngagatgatacgtagactcgtacaagtaggacgtaggtagtagtgtatcg

SEQ ID NO: 371637 - DNA, 601 bp, Homo sapiens
  misc_feature: GZ8MTXP02F9T34.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaaggggctgggaggtggggtggaccaaacaataaaacgaaaggacggaagtaccaagaaaaaacctagtagtaggaactcgtgtaggaaccgggccgaattcaccctatctccaagacgaacaaccgaccaaagaacttacaactgttaatttgactaaaatgaaacacgcctaggaaggacgggacggaaggaccgacgggtccgtagttaattagtagtgcgacgagagtagaagtagtacgtactctaacgaaggttagcgtagggtgtagtgatttgg

SEQ ID NO: 371638 - DNA, 630 bp, Homo sapiens
  misc_feature: GZ8MTXP02JLX6W.15.67.G01.1.454.CMB.2.raw
  modified_base (603)..(603): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgagggcccgggggggtccctggagactctcctgtgcagtctctggattcacccttagaagttattggatgacctgggtcccgccaggctccgagggaaggggctggaggtgggtggccaaacaataaaacaaaaggaacgggaaagtacgaaagtaaaaaaccctagtaggtaggaacttcgtaggttacggaaccgggcccggtaatttccaaccctatccctacccaagacgaaaccgaaaccgacccaaaggaacttaccacttgtattttagactaaaactgtaaacagtcctaggaggacggacgggaaggaccgaccggtaccggtgtacgttagttgtgacgtcgagatgattagacgtactcgtanaagtacgcgtaaggtggtatcgtattg

SEQ ID NO: 371639 - DNA, 543 bp, Homo sapiens
  misc_feature: GZ8MTXP02IEVAH.15.67.G01.1.454.CMB.2.raw
  modified_base (346)..(346): a, c, t, g, unknown or other
  modified_base (495)..(495): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggcttggtccaggccgggggggtccctgagactctcctgtgcagtctctggattcacccttagaagttatggatgacctgggtccgccaggctccgaggggaaggggctgggagtgggtggccaanaataaacaaagacggaagtcaagaaaacctatgtaggactctgtgacgggccgattccaccatctcagacacaacgaccaagaacttcactgtatttgacaaatgaaacagcctaggagaggcgaggacacggcgtgtattatgtgcgngagatgaatacgtagacttctagaagtcgacgaggtggtatgatttcg

SEQ ID NO: 371640 - DNA, 584 bp, Homo sapiens
  misc_feature: GZ8MTXP02JEGI5.15.67.G01.1.454.CMB.2.raw
  modified_base (347)..(347): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttatttagaaggtgtccagtgtgaggtgcacttggtggagtcgtgggggaggcttgggtccaggcccggggggggtccctggagactctcctgtgcagtctctggattcaccttagagttattggatgacctggtccgccaggctccgaggggaaggggctggaggtgggtggccaaanataaaacaaaggacggaagtacaaagaaaaacctagtgtaggaactcgtagtaggaccggccgtaattaccaccatcctaccgaagagaaccaaacgaccaaagaacttacactgtaatttgacaaatgaaacagacctaggaagagggacgaaggaccgacggccgttagtaattagtggtgccggacgagagtgaataggtacactacagaagtagcgaggtagtatcgatttcg

SEQ ID NO: 371641 - DNA, 547 bp, Homo sapiens
  misc_feature: GZ8MTXP02GQIRZ.15.67.G01.1.454.CMB.2.raw
  modified_base (301)..(301): a, c, t, g, unknown or other
  modified_base (330)..(330): a, c, t, g, unknown or other
  modified_base (370)..(370): a, c, t, g, unknown or other
  modified_base (398)..(398): a, c, t, g, unknown or other
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccgggggggtccctgagactctcctgtgcagtctctggattcacctagaagttatggatgacctgggtccncaggctccaggggaagggctggagtgggnggccaaacataaaacaaagacgaagtcaagaaaaaccctnagtggaactctgtgacgggcattcaccntctcagacgacaaccgcaaagaatcactgtatttgacaaatgaaacagcccgtagaggacggcggaaggaccgacggcgtagtattatgtagcagagatcgaatacgtagactagtaacaaggtanacgtaggtaggtatggtacttgg

SEQ ID NO: 371642 - DNA, 555 bp, Homo sapiens
  misc_feature: GZ8MTXP02JNW3M.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccgggggggtccctgagactctcctgtgcagtctctggattcacccttagaagttattggatgacctgggtccgccaggctccgaggggaaggggctggagtgggtggccaacataaacgaaagacggaagtacgaagaaaaaccctatagtaggactctgtagaccggccgattcgaccatcctaccagacgacaaacgccaaagaatcactgtattgacaaatgaaacagccagaggaggcggagacgacggcgtagtattagtgtgcgagagatgaatagtacgactctaacgaagtagacgaggttaggtatagtattg

SEQ ID NO: 371643 - DNA, 559 bp, Homo sapiens
  misc_feature: GZ8MTXP02JBX7X.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttattggatgacctgggtccgccaggctccgaggggaaggggcgtgggaggtggggtggccaacataaaacgaaagacggaagtacaagaaaaaccctagtgtaggactctggtgacggccgattccaccatcaccagagacaacgaccaagaacttcactgtattgacaaatgaacagctagagaggcgaggacgacggcgtgtacttagtgtgcgcgagagtgagtagtacgactctaacgaagtaacgcgtagggtgtaacgtgtatttgg

SEQ ID NO: 371644 - DNA, 618 bp, Homo sapiens
  misc_feature: GZ8MTXP02F9DRB.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtgggagtcgtggggggagggcttgggtcccgagggccgggggggtccctggagactctcctgtgcagtctctggattcacccttagaagttattggatgaccgtgggtccgccaggctccgaggggaggggctgggagtggggtggaccaaacataaaacgaaaagaacggaagtacaaagaaaaaaccctagtggtaggacttcgtaggtaggaaccgggccgaattccaaccctattcctaccaagaacaaccgaaaccgacccaaaagaaacttacaactgttaatttgacaaaatgaaacagaccctaggagagggacggaaggaaccaccgggaccgttggttaattagttgcgtcggcgagatgaatagtagaacctctaacgaagttagactagggtgtatgagtttg

SEQ ID NO: 371645 - DNA, 803 bp, Homo sapiens
  misc_feature: GZ8MTXP02JJBDL.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgactggtccgccaggctccaggggaaggggcgtgggaggtggggtggccaaacgaataaaacgaaaaggaaccgggaaagtaccgaaaggaaaaaaccctagtaggtacggaacttcgtaggttacggaccggggccgaagtttccaacccgtattacccttacccgaaaggaacgaaacccaaaacccggacccaaaaggtaaactttaccaaccgtttagggtttaaactttttacgggaaccctaaaaagttacggaaaaaccgaccggtaacccccgttaagggaacgggaacgggggaccgggaaacgggggaaaacccgaacccgggggttaccccgggttagtttaaacgtttaaggttttgggttacgggacccggacggtaaggaggtttacggaaagtttaaaggggtaacgttaaaccgttaccgttaaaaccgtaaggtttaaacggccggttaaaacgggggtacggtttaaaggttacggttaaacgttttacggg

SEQ ID NO: 371646 - DNA, 554 bp, Homo sapiens
  misc_feature: GZ8MTXP02J29AQ.15.67.G01.1.454.CMB.2.raw
  modified_base (352)..(352): a, c, t, g, unknown or other
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcgttgggtccgagggcccgggggggtccctggagactctcctgtgcagtctctggattcacccttagaagttattggatgacctgggtccgccaggctccgaggggaaggggctggagtgggtggccaanataaaacaaaggacggaaagtcaaagaaaaaccctatgtaggactctggtagaccggcgattccacatctaccagagaacaacgaccaaagaacttcactgtatttgacaaatgaaacagcctgagaggcgaggacacgggctagtattagtgtgcgcgagatgatagtagactacacgngtagcgtagggtgtatgacttg

SEQ ID NO: 371647 - DNA, 560 bp, Homo sapiens
  misc_feature: GZ8MTXP02IQQKF.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggcccgggggggtccctggagactctcctgtgcagtctctggattcacccttagagttattggatgacctgggtccgccaggctccgaggggaaggggctgggagtggggtggccaaacataaaacaaagacggaagtacaagaaaaacctatgtggactctgtgacggccgatccaccatctccagacgacaacgccaaagattcactgtaatttgacaaaatgaaacagaccctgagagggcggaaggaccgacggcgtagtatttagtgtagcgcgagatgaatagtacgaactcgtaacaaggttagacgagggtaggtatcgagttg

SEQ ID NO: 371648 - DNA, 636 bp, Homo sapiens
  misc_feature: GZ8MTXP02GOCOL.15.67.G01.1.454.CMB.2.raw
  modified_base (402)..(402): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttgggtggagtcggtgggggaggcgttgggtccgagggcccgggggggtccctggacgcctctcctgtgcagtctcgtggattcacccttagaagttattggatgaccgtgggtccgccaggcctccgagggggaaggggctgggaggtggggtcggaccaaacataaaacgaaaggaacggaagtacaaagaaaaacctntggtagactcgtgtaggaccggcgtattaccaccatctacgagaacgacaaccgacaaagaacttcactagttatttgaacaaagtcgaaacacgtaccgtagaggaggacggacggactacgggcgttagtactttagtggtgcgtacgaagattaggaaagttacgtaacgtaccttacgttaacgtaaggttaacgcggtaaggggttaggtaagttaggtagttttacgg

SEQ ID NO: 371649 - DNA, 563 bp, Homo sapiens
  misc_feature: GZ8MTXP02HKGN3.15.67.G01.1.454.CMB.2.raw
  modified_base (420)..(420): a, c, t, g, unknown or other
  modified_base (499)..(499): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaggggctgggagtggggtggccaaacataaaacaaaagacggaagtacaagaaaaacctatagtggactcgtgtgacggccgattcacccatctaccaganacaacgaccaaagaattcactgtatttgacaaatgaaacagacctagagaggacggaggacacggccgtgtattattgngtacggcgagagtagtagtagtagtacgtactacgtaagtagacgtaggtaggtagtagtagtg

SEQ ID NO: 371650 - DNA, 571 bp, Homo sapiens
  misc_feature: GZ8MTXP02FNYR4.15.67.G01.1.454.CMB.2.raw
  modified_base (383)..(383): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaaggggctgggagtggggtggccaaacaataaaacgaaagacggaaagtacaaagaaaaacctntagtaggactctgtagacgggccgattcacctatctaccaagacgaacaaccgaccaaagaattcactgttatttagacaaaatagaaacagcctagagaggacgaggaccgacggcgtgtagttattgtgcgcgagagtgaagtacgtacgaactctaacgaagtagcgtaggtggtaatcgaattg

SEQ ID NO: 371651 - DNA, 533 bp, Homo sapiens
  misc_feature: GZ8MTXP02IKDD9.15.67.G01.1.454.CMB.2.raw
  modified_base (385)..(385): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctgggagtgggtggccaaacataaaacaaagacgaagtacagaaaaacctatgtggactntgtgacggcattccaccatctacagagacaacgccaaagattcactgtattgacaaatgaaacagcctgagaggcgaggacacggcgtagtattattgtgcgcgagatgaatagtagactctacaagtagcagggtagtagtgtattg

SEQ ID NO: 371652 - DNA, 574 bp, Homo sapiens
  misc_feature: GZ8MTXP02GY2IG.15.67.G01.1.454.CMB.2.raw
  modified_base (472)..(472): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctggagactctcctgtgcagtctctggattcacccttagaagttattggatgacctgggtccgccaggctccgaggggaaggggctgggaggtggggtggccaacataaaacgaaagacggaagtacaagaaaaacctgtagtaggactcgtgtacgacgggccgtaattccgaccatctccaagagacaacgaccaaagactcactgtactttagacaaatgaaacncgcctagagaggacggagacgacggcgtgtacgttattaggtgcggtagagagtagatagtacgactctaacgaagtacgacgtagggtgtacgtgagtttg

SEQ ID NO: 371653 - DNA, 553 bp, Homo sapiens
  misc_feature: GZ8MTXP02HTS9P.15.67.G01.1.454.CMB.2.raw
  modified_base (343)..(343): a, c, t, g, unknown or other
  modified_base (413)..(413): a, c, t, g, unknown or other
  modified_base (500)..(500): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgacctgggtccgccaggctccgaggggagggctggagtggggtggccaanataaaacaaagacggaaagtcaagaaaacctagtagtggactctgtgacggccgattcaccatctcaganacaacgccaaagaattcaactgttatttgactaaatgaaacagacctggaacgagggacgaggacgacggcgtagtattatgtgcgngagatgattacgtacgacttacacgtaagtacgacgtagggtagtatgtattg

SEQ ID NO: 371654 - DNA, 550 bp, Homo sapiens
  misc_feature: GZ8MTXP02H2P3E.15.67.G01.1.454.CMB.2.raw
  modified_base (348)..(348): a, c, t, g, unknown or other
  modified_base (380)..(380): a, c, t, g, unknown or other
  modified_base (410)..(410): a, c, t, g, unknown or other
  modified_base (415)..(415): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggcccgggggggtccctggagactctcctgtgcagtctctggattcacccttagaagtttattggatgacctgggtccgccaggctccaggggaaggggctggagtgggtggccaanataaacaaagaacggaagtcaagaaaaacctntgtggactctgtagacggcgattcacatcncaganacaacgaccaagaatcaatgtatttagacaaatgaacagcctagagaggcgagacgacggccgtagtattatgtagcgtcgagatgaagtagtagactactacgaagttagacgtagggtgtaactgtaattcgg

SEQ ID NO: 371655 - DNA, 534 bp, Homo sapiens
  misc_feature: GZ8MTXP02HRK86.15.67.G01.1.454.CMB.2.raw
  modified_base (307)..(307): a, c, t, g, unknown or other
  modified_base (344)..(344): a, c, t, g, unknown or other
  modified_base (383)..(383): a, c, t, g, unknown or other
  modified_base (410)..(410): a, c, t, g, unknown or other
  modified_base (429)..(429): a, c, t, g, unknown or other
  modified_base (466)..(466): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcacccttagaagttattggatgacctgggtccnccaggctccgaggggagggctggagtgggtggccaanataaacaaagacggaagtcaagaaaacctatgtagactntgtgacggcgattcacccatctcaganacaacgcaaagattcactntatttgacaaatgaaacagcctagagagacggagacncggccgtagtattattagacgacgagatgatagtagactcacagtaagcaggttggatgtatgtttcg

SEQ ID NO: 371656 - DNA, 565 bp, Homo sapiens
  misc_feature: GZ8MTXP02F2WA7.15.67.G01.1.454.CMB.2.raw
  modified_base (473)..(473): a, c, t, g, unknown or other
  modified_base (520)..(520): a, c, t, g, unknown or other
  modified_base (540)..(540): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccgggggggtccctgagactctcctgtgcagtctctggattcacccttagaagttattggatgacctgggtccgccaggctccgaggggaagggctggagtgggtggccaaacataaaacaaaagacggaagtacaagaaaaaacctatggtagactctgtagacggccgaattcacccatcctaccaagagaacaaacgaccaaagaaattcaactgtaatttgacaaaatgaaaaccanccgtagaagaggcgaaggaccgacggccgtagtattatgtgcgcganatgatacgtagactctaaanaagtagacgtaggtagtagtgtatg

SEQ ID NO: 371657 - DNA, 562 bp, Homo sapiens
  misc_feature: GZ8MTXP02IHGFP.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggattcacccttagaagttattggatgacctggtccgccaggctccgaggggaggggctgggagtgggtggccaacaataaaacgaaaggaacggaaagtacaagaaaaaccctatagtaggactctgtagacggccgattccaccatctaccagacgacaaacgaccaagaactcactagttatttagacaaatgaaacagcctagagaggacggaggacgacggccgtagtattatgtgcgcgagatagatacgtacgactactacgaagtagacgaggtagtatagtattgg

SEQ ID NO: 371658 - DNA, 572 bp, Homo sapiens
  misc_feature: GZ8MTXP02F191D.15.67.G01.1.454.CMB.2.raw
  modified_base (344)..(344): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtcccaggccgggggggtccctgagactctcctgtgcagtctctggattcacccttagaagttattggatgacctgggtccgcaggctccaggggaagggctgggagtgggtggccaanataaacaaagacggaatacaagaaaaacctatgtggactctgtagacggcgattcaccatctccagacgaacacgaccaaagaacttcaactgtatttagactaaaagtcgaaacagccgtagaagaggacggaaggaccgacggccgtagttattagttgtgacgcgagatgaagtaagtacgtaactctaacgaaggtagacgtagggtggtaatacggtatttgg

SEQ ID NO: 371659 - DNA, 541 bp, Homo sapiens
  misc_feature: GZ8MTXP02HUUZY.15.67.G01.1.454.CMB.2.raw
  modified_base (494)..(494): a, c, t, g, unknown or other
  modified_base (497)..(497): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtcctgagactctcctgtgcagtctctggattcacccttagaagttattggatgacctgggtccgcaggctccgaggggaggggctgggagtgggtggccaacaataaaacaaagacggaagtcaagaaaaacctatagtgactctgtgacgcgtatcaccatctcagagacaacgccaagaattcactgtatttgacaaatagaaacagcctaggagagggacggaaggacacgggccgttgtattatgtgcgnganatagatagtacgactacacaagtagacgagggtgtatgtagttg

SEQ ID NO: 371660 - DNA, 566 bp, Homo sapiens
  misc_feature: GZ8MTXP02JGDI0.15.67.G01.1.454.CMB.2.raw
  modified_base (349)..(349): a, c, t, g, unknown or other
  modified_base (380)..(380): a, c, t, g, unknown or other
  modified_base (383)..(383): a, c, t, g, unknown or other
  modified_base (412)..(412): a, c, t, g, unknown or other
  modified_base (423)..(423): a, c, t, g, unknown or other
  modified_base (455)..(455): a, c, t, g, unknown or other
  modified_base (510)..(510): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatgagttggggctgagctgggttttccttgttgttattttagaaggtgtccagtgtgaggtgcacttggtggagttctgggggaggcttgggtccaggcccgggggggtccctggagactctcctgtgcagtctctggattcacccttagaagttattggatgacctgggtccgccaggctccgaggggaaggggctgggagtggggtggccaaanataaacaaagacgaagtacaagaaaaacctntgnggactctgtgacggcgatcacatctacanagacaacgacncgaatactacattgattagactaaatgaaacngaccgtagacggagggacgaggaccgacgggcgtagtagttagtgtgacggaganacgtagaagtacgtacgtaacgtacgtaacgagtacgcgtaaggtcggtaattgga

SEQ ID NO: 371661 - DNA, 538 bp, Homo sapiens
  misc_feature: GZ8MTXP02HKTE0.15.67.G01.1.454.CMB.2.raw
  modified_base (465)..(465): a, c, t, g, unknown or other
  modified_base (531)..(531): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgagggaggggctggagtgggtggccaacataaacaaagacggaagtcaagaaaaacctatagtggactctagtgaccgggccgattccaccatctaccagagacaaacgccaaagaattcactgtattgacaaatgaaacagcctgagaggngagacgacggcgtgtattatgtgcgtgagatgatacgtagactctacaagtagacgtaggtgtagngtattcg

SEQ ID NO: 371662 - DNA, 599 bp, Homo sapiens
  misc_feature: GZ8MTXP02GWNOF.15.67.G01.1.454.CMB.2.raw
  modified_base (316)..(316): a, c, t, g, unknown or other
  modified_base (319)..(319): a, c, t, g, unknown or other
  modified_base (468)..(468): a, c, t, g, unknown or other
  modified_base (471)..(471): a, c, t, g, unknown or other
  modified_base (477)..(477): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttctgttagttatttagaagtgtcagtgtgagtgcacttggtggagtcgtgggggagcttggtccaggccggggggtcctgagactctcctgtgcagtctctggattcacccttagaagttattggatgacctgggtccgcaggctccaggggagggcnggnggtaggtggccgaacaataaacaaaagaacgggaagacgtaagaaaaaccgtaatagtacggtacgtacttaggagacgggaccgacttaccaaccactactccacgaagacaaaccgtacccaaagtatactactagttatttagaanaanaagaanacgacgagagaggacggacggacgacggacgtacgtagttagttagtgtacgacgagagtagtagtaacgtacgtaacgtacgtacgtaagtacgtacggtacggtaggtacgtagtagtag

SEQ ID NO: 371663 - DNA, 777 bp, Homo sapiens
  misc_feature: GZ8MTXP02IO9VQ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgctacgttgggtggagtcggtgggggaggtcgttgggtccgacggggcccgggggggtccctggacgtaccttccgtccgttggtcgcgtagttcctcgtgggtacttcctaaccccgttaagaaagtttagttgggatacggtacccgtcggggtccccgccgaacgggtcctacccggaaggggggaacggggtcgtggggaaggtgggggtcggaccccaaaactaaacgtaaaaacgaaaaggaacgggaaagtacgaaaagtaaaaaacccgtagtagggtacggtaacttcgtaggttacggaaccggggtccgttaaacttacccaaccctaagttccctacccgaaaggacgaaaccaaaaccggtacccaaaaggtaaacttaccactttaggttaatttacggaaacctaaaagttacgaaaactacggtccgtaagggacggaacgggaccgggtaagggaaccgaccggggtaccggttacggttaagtttaggtggtacgccggtacgagtagtagtaagtaagtacgtacctagtaacgaagtagacgtaggtagtagtgtagtttgg

SEQ ID NO: 371664 - DNA, 699 bp, Homo sapiens
  misc_feature: GZ8MTXP02JD6YA.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtggaggtgcacttggtggagtcgtgggggaggcttggtccaggccgggggggtccctggagactctcctgtgcagtctctggattcacccttagagttatggatgaccgtgggtccgccaggctccgaggggaaggggctggaggtggggtcggaccaaacaataaaacaaaggaacggaaagtacgaaagaaaaaacctagtagtaggacttcgtaggttacgaccgggccgtaattccgaaccaattcctacccgaagaacgaaaccaaaccgacccaaaaggaaactttcccgaacttacggttaattttcggaactaaaacgttagaaaaccgagtacccgttaggaaggaaggggaccgggaaaggggaccgtaaccggggacccggttaggtaacgttttagtttacggtggtaccggaccggaagtacgtaggtaaattaaaggtacggtaacctcgtaaacaaggtacgacggtagggttaggtacgttaggtatttacggg

SEQ ID NO: 371665 - DNA, 609 bp, Homo sapiens
  misc_feature: GZ8MTXP02JDKE1.15.67.G01.1.454.CMB.2.raw
  modified_base (282)..(282): a, c, t, g, unknown or other
  modified_base (386)..(386): a, c, t, g, unknown or other
  modified_base (430)..(430): a, c, t, g, unknown or other
tcagtctacgtagccacgaccggtgctcgatttagagtatacatattggggtttgaggtctcagagaggagccttagccctggactccaaggcctttccacttggtgatcagcactgagcacagaggactcaccatggagttgggggctgagctgggttttccttgttgttattttagaaggtgtccagtgtgaggtgcacttggtggagttctgggggaggcttggtccaggccgggggggtccctgagactctcctgtgcagtctctggattctaccganccttagttggatgacctgggtccgccgaggctcgaggggagggctcggaggtggtgaccaacaataaacaaagacgaagtacaagaaaacctgcgtgactctgngacggcctatccactatctaccagaacgaccaaacggaaccctnaaagtaactacaactacgtaattagtactaaagtacgtaacgacgacgtacgaggacggacggacggacgacggtacggtcgttagttagtacggtacggtacggacggagtacgtagtaacgtacgtacgtaacgtacgtaacgtacggtacggtacgtaggtcgtaacgttaggtag

SEQ ID NO: 371666 - DNA, 587 bp, Homo sapiens
  misc_feature: GZ8MTXP02GUG98.15.67.G01.1.454.CMB.2.raw
  modified_base (527)..(527): a, c, t, g, unknown or other
  modified_base (560)..(560): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagactcaccatggagttgggctgagctgggttttccttgttgttattttagaaggtgtccagtgtgaggtgcacgttggtggagtcgtgggggagcgttggtccgaggccggggggtccctgagactctcctgtgcagtctctggattccaccttagaagttattggatgacctggtccgccaggctccgaggggagggctggagtgggtggaccaaagaataaaacgaaagaacggaataccaaagaaaaaccctgtagtacggacttcgtgtacgacgggcctattaccgacctatcctaccagacgaacaaccgaaccaaagaactttacaacttagttaatttagaactaaatagaaactacgcctaggagaggacgaaggacgacggccgttgtaattntgtgcgcgagatagtatagtacgactacgtaanaagtagacgtagggtgtagtgtattcg

SEQ ID NO: 371667 - DNA, 579 bp, Homo sapiens
  misc_feature: GZ8MTXP02ITG4V.15.67.G01.1.454.CMB.2.raw
  modified_base (425)..(425): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccggggggtccctgagactctcctgtgcagtctctggattcacccttagaagttatggatgaccgtgggtccgccaggctccgaggggaaggggcgtggagtggggtggccaaacgataaaacgaaagacggaaagtacgaaagaaaaaccctatgtaggactcgtgtagacggccgattcaccatctaccaganacaaacgaccaaagaacttcactgtatttagacaaatgaaacagacctagagaggcggaagaccgacggccgtgtattagtgtgcgtacgagagtagtaataggtacgacttccgtaagaagtacgacgtagggtagtaacgtgtaagtttcgg

SEQ ID NO: 371668 - DNA, 548 bp, Homo sapiens
  misc_feature: GZ8MTXP02HGEWF.15.67.G01.1.454.CMB.2.raw
  modified_base (388)..(388): a, c, t, g, unknown or other
  modified_base (411)..(411): a, c, t, g, unknown or other
  modified_base (417)..(417): a, c, t, g, unknown or other
  modified_base (522)..(522): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaaggggctgggagtggggtggccaacataaaacaaagaacggaagtacaagaaaaacctatgtggactntgtagacggccgattcaccatcnccaganacaacgccaaagatacactgtatttgacaaatgaaacagcctagagaggcggaagaccgacggcgtagtattatgtcgcgacgagatgaatagtacgactcgtanaagtagacgtaggtgtactgtattcg

SEQ ID NO: 371669 - DNA, 554 bp, Homo sapiens
  misc_feature: GZ8MTXP02ISCE8.15.67.G01.1.454.CMB.2.raw
  modified_base (331)..(331): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggacgactctcctgtgcagtctctggattcacccttagaagttattggatgacctgggtccgccaggctcccgaggggaagggcngggagtgggtcggccaaacaataaaacaaaagacggaagtaccaagaaaaaacctagtagtggaactctgtgacggcgattcacctatctacagagacaacgaccaagaatcactgtattagacaaatgaaacagcctagagaggcgaaggacacggcgtgtattagtgtgcgtcgagatgatagtacgactactacaagtagacgtagtaggtatcgtattg

SEQ ID NO: 371670 - DNA, 566 bp, Homo sapiens
  misc_feature: GZ8MTXP02F08HO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaagttattggatgacctgggtccgccaggctccaggggaaggggctgggagtggggtggccaacataaacaaagacggaagtcaagaaaaacctatgtggactctgtgacgggccgattcaccatctccagagacaacgccaagaattcactgtatttgacaaatgaaacagcctaggacgaggacggaaggaaccacgggaccgtgtaattattggtagcgacgagatagaagtagtacggactcgtaaccaagttacgcgtaagggtgtaatggtaactttgg

SEQ ID NO: 371671 - DNA, 599 bp, Homo sapiens
  misc_feature: GZ8MTXP02I1RFI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtggggtcggacccaaacaataaaacgaaaggaaccgggaagtaccaaagaaaaacctatgtggactcgtggtcgacggccgaattccacctatcctaccagacgaacaacgaccaaagaattcactgtatttgacaaatgaaacagcctaggagagggcgaaggaccgacgggtaccgtagttaatttagtgtgaccgtaggagagtagaattaggttacgaccttctaacgaaggtacgacgtaggggtagtatacggtatttgg

SEQ ID NO: 371672 - DNA, 587 bp, Homo sapiens
  misc_feature: GZ8MTXP02JNF3G.15.67.G01.1.454.CMB.2.raw
  modified_base (341)..(341): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtcctgagactctcctgtgcagtctctggattcacccttagaagttattggatgacctgggtcccgcaggctccgaggggagggctggagtgggtggccaanataaacgaaagacggaagtacaagaaaaacctatgtaggactcgtagtgaccgggccgtattccaccagtactccagacgacaaaccgaccaaagaattacactgtattttagacaaaatagaaacacgaccgtgaaggacgggacggaaggacgacgggccggtttagtaagtttagttgtcgacgtacgagatggataacgtacgactctaagaagtacgcgagggtagtagtacggtatttcg

SEQ ID NO: 371673 - DNA, 551 bp, Homo sapiens
  misc_feature: GZ8MTXP02GRK33.15.67.G01.1.454.CMB.2.raw
  modified_base (342)..(342): a, c, t, g, unknown or other
  modified_base (459)..(459): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccggggggtccctgagactctcctgtgcagtctctggattcacccttagaagttattggatgacctgggtccgcaggctccgaggggagggctggagtgggtggccaanaataaaacaaagaacggaagtacaagaaaaacctatgtaggactcgtgtacgaccgggccgattccactatctacagaagacaacgacaaagaatcactgtattgacaaatgaaacngcctgagagggacgagacgacggcgtagtattagtgtagcgacgagtatagagttagtacgactctacgaagtagcgaggtgtatcgtattg

SEQ ID NO: 371674 - DNA, 559 bp, Homo sapiens
  misc_feature: GZ8MTXP02GBYIF.15.67.G01.1.454.CMB.2.raw
  modified_base (346)..(346): a, c, t, g, unknown or other
  modified_base (382)..(382): a, c, t, g, unknown or other
  modified_base (490)..(490): a, c, t, g, unknown or other
  modified_base (510)..(510): a, c, t, g, unknown or other
  modified_base (551)..(551): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttggtccgagggcccgggggggtccctggagactctcctgtgcagtctctggattcaccttagaagttattggatgacctgggtccgccaggctccgaggggagggctggagtgggtgccaanaataaacaaaggacggaatacaagaaaaacctatgngactcgtgtagacgccgattccaaccatctccaagacacaacgaccaaagaattcactgttattagacaaatgaaacagcctagagaggacgaaggaccagggccgtntattagtgtggcgcgagtanggaatacggtagactctaagaagttagacgtaggtaggtancgagtttg

SEQ ID NO: 371675 - DNA, 524 bp, Homo sapiens
  misc_feature: GZ8MTXP02GFKQ3.15.67.G01.1.454.CMB.2.raw
  modified_base (374)..(374): a, c, t, g, unknown or other
  modified_base (382)..(382): a, c, t, g, unknown or other
tcagtctacgtagccacgaccggtgctcgatttagagtatacatattgggtttgaggtctcagagaggagccttagcccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccgccaggctccgaggggaaggggctggagtggggtggccaacataaacaaagacggaagtcagaaaaacctngtgactcngtgacggcgattcaccatctccagagacaacgccaagattcactgtattgcaaatgaaacagcctagagaggcgagacacggcctgtattatgtgcgcgagatgatagtacgactctacaagtagcgaggtggtaatgatcg

SEQ ID NO: 371676 - DNA, 558 bp, Homo sapiens
  misc_feature: GZ8MTXP02HN0NC.15.67.G01.1.454.CMB.2.raw
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaaggtgtccagtgtgaggtgcacttggtggagtctgggggagcttggtccaggccgggggggtccctgagactctcctgtgcagtctctggattcacccttagaagttattggatgacctgggtccgcaggctccaggggaggggctgggagtgggtcggccaaacagtaaaacaaagacggaaagtcaagaaaaaccctatgtgactctgtgacggccgattccacctatctcagagacaacgaccaagattcgactgtactttgacaaatcgaacacgctaggagagggacgaggactaacgggccgtgtattattggtgcgtacgtagatagagttacgagaccttanacgtaagtacggcgtaggtaggtatacgtatg

SEQ ID NO: 371677 - DNA, 802 bp, Homo sapiens
  misc_feature: GZ8MTXP02JH0HZ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccggggggtccctggagactctcctgtgcagtctctggattcaccttagaagttatggatgaccgtgggtcccgcaggctccgaggggaacggggcgtgggaggtggggtcggacccaaacaacgtaaaacgaaacggaaccgggaaagtacgaaagaaaaaacccgtagtaggtacggacctcgtaggtacggaaccggggtccgtaactttccaaccccgtattacccgtaccaaacggaacgaaaccgaaaccgaccccgaaaaaggtaactttaccaaacccgtttggtttaaatttttacggaacctaaaaagttacggaaaaacccgacggtaaccccgttagggaacgggaacgggaccggggaaacggggaaccccggaaaccggggtcccggttaggtttaaaacgttttacggttaggtcgggaccggacgggtaaggtaagttaaacgggaaagtttaaacggttaacccggtaaacctttaacccgaaacgtaacgggttaaaggtaccggttaaggggggtttaaggtaacgtttacgggggtaactttttccggg

SEQ ID NO: 371678 - DNA, 608 bp, Homo sapiens
  misc_feature: GZ8MTXP02GTEEU.15.67.G01.1.454.CMB.2.raw
  modified_base (305)..(305): a, c, t, g, unknown or other
  modified_base (309)..(309): a, c, t, g, unknown or other
  modified_base (314)..(314): a, c, t, g, unknown or other
  modified_base (329)..(329): a, c, t, g, unknown or other
  modified_base (350)..(350): a, c, t, g, unknown or other
tcagtctacgtagccacgaccggtgctcgatttagagtatacatattgggtttggggggtccctgagactctcctgtgcagtctctggattcacccttagaagttattggatgacctgggtccgccaggctccagggaaggggctggagtgggtggccaaacataaaacaaagacggaagtcaagaaaaaactatgtggactctgtgaacggccgattcaccatctccagagacaaacgccaaagaattcactgtatttgcaaatgaacagcctgagaggcgaggacacggccgtgtattattgngcgngagangatagagactctaanagtagcgaggtgtatgatgtntttgatagtcggacggggacaaagggacaggtcgacaccgtctacttcacgccctaccaaccgaacggcccagtccggtcccttcccccgtcggcccgccctcgaccgtaccgaacggacgtacccgacccgtacgacgacgaccgaaccgcggccggtcccgtgggcctcgcccgtaggtaccgaaacggtaccttaccgttccgacgtaccgtaacgaccgaggaacggcgggtcgacggacgaacggacgacacg

SEQ ID NO: 371679 - DNA, 647 bp, Homo sapiens
  misc_feature: GZ8MTXP02IG7XL.15.67.G01.1.454.CMB.2.raw
  modified_base (308)..(308): a, c, t, g, unknown or other
  modified_base (329)..(329): a, c, t, g, unknown or other
  modified_base (559)..(559): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttgggtccaggccgggggggtccctgagactctcctgtgcagtctctggattccaccttagaagttagtggatgaccgtgggtccncaggcctccgaggggagggcngggaggtgggtcggacccaaacgaataaaaacgaaaggaacggaacgtacgaaaacgaaaaaccctagtggtacggaacttcgtaggtacggaaccggggcctattccaaccctatcctacaacgaagaaccaaaccgaccaaagtaacttaccattagttaatttggaactaaaagtgaaaccagtcctaggaggaagggcggacggacgacggtccgtagttaagttnttcggtgaccgacggagtagagtaagtaccgtaagaccttacctaacgtaaggttacgacggtaggggttagttagtagtaagtttgg

SEQ ID NO: 371680 - DNA, 528 bp, Homo sapiens
  misc_feature: GZ8MTXP02G6VRI.15.67.G01.1.454.CMB.2.raw
  modified_base (371)..(371): a, c, t, g, unknown or other
  modified_base (411)..(411): a, c, t, g, unknown or other
  modified_base (480)..(480): a, c, t, g, unknown or other
  modified_base (488)..(488): a, c, t, g, unknown or other
  modified_base (490)..(490): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgacctggtccgcaggctcaggggaagggctggagtgggtgccaacataaacgaaagacggaagtacaagaaaaacctntagtggactcgtagtgacggccgattcaccatctccaganacaacgccaagactcactgtattgacaaatgaaacagctagagagcggagacacggcgtgtattagtgngtcgcganangatagacgactctagaagtagacgaggtgtagtgattg

SEQ ID NO: 371681 - DNA, 726 bp, Homo sapiens
  misc_feature: GZ8MTXP02GHMCV.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttatttagaaggtgtccagtgtgaggtgcacgttggtggagtcggtgggggaggtcgttgggtccgacgggcccgggggggttccctggacgacctcctccgtgtgcagtcttctggtattccacccttaagaagttattggatcgaccgtgggtcccgccgaggcctaccggaggggaaggggcgtgggaggtggggtcggaccctaaaacgaaataaaacgaaaggaacggaaagtacaaaagaaaaaaccctgtagtaggacctcgtgtacgggaccggccgtaacttccaacctatccgtaccaagaacgaaaccaaaccggaccaaaacgtaactttccctaaacgtaggttttaaatttacggaacctaaaaagtcgaaaaccgtacggacccgtagggaaggacgggaccgggaacggaaccgtacccgggtaccggttagtttaaacgtttgttaggtggaccggtacggaagtagtagtaaagttacgtaacgtaactaccgttaagaacggttacggacgtaaggggttagtaagtaggacgttttgg

SEQ ID NO: 371682 - DNA, 543 bp, Homo sapiens
  misc_feature: GZ8MTXP02I0HBL.15.67.G01.1.454.CMB.2.raw
  modified_base (414)..(414): a, c, t, g, unknown or other
  modified_base (417)..(417): a, c, t, g, unknown or other
  modified_base (520)..(520): a, c, t, g, unknown or other
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcacccttagagttattggatgacctggggtccgcccaggctccgaggggaaggggctggaggtggggtggccaaacataaaacaaaggacggaagtacaagaaaaaccctatgtggactctgtgacgggccgattcaccntcnccagagacaacgccaaagatcactgtatttgacaaatgaaacagacctgagaggcggaggacacggcgtgtattatgtgcgcgagatgatagtagactctaangtacgngaggtgtatggtactgg

SEQ ID NO: 371683 - DNA, 592 bp, Homo sapiens
  misc_feature: GZ8MTXP02HRWI7.15.67.G01.1.454.CMB.2.raw
  modified_base (348)..(348): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttatggatgacctgggtccgccaggctccgaggggaaggggctgggaggtgggtggacccaaanaataaaacaaagaacgggaaagtacaaagaaaaaccctatagtaggactctggtacgaccggccgattccacccatcctacccaagacgaaccaaacgacccaaagaacttcactgtatttgactaaatgaaacagcctagagagggcgaggacgcggaccgtgtattacgttgtgacgtacgagtatagatagtacgacttactaacgaaggttacgacgtagggtaggttataggtatttgg

SEQ ID NO: 371684 - DNA, 580 bp, Homo sapiens
  misc_feature: GZ8MTXP02II324.15.67.G01.1.454.CMB.2.raw
  modified_base (535)..(535): a, c, t, g, unknown or other
  modified_base (553)..(553): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccagggcccgggggggtccctggagactctcctgtgcagtctctggattcacccttagaagttattggatgacctgggtccgccaggctccgaggggaaggggctggagtgggtggccaaacataaaacaaaagaaccggaaagtacaaagaaaaaacctagtagtaggaactcgtagtgaacggcccgaattccaccaatctaccagaagaacaaacgacccaaagaaattacaactgtaatttgacaaaatgaaacagcctagagaggcgaaggacgacggaccgtagtattagttgtgcgcgagntgatagacgactcctaanaagtagacgaggtaggtagtagattag

SEQ ID NO: 371685 - DNA, 595 bp, Homo sapiens
  misc_feature: GZ8MTXP02HYAPT.15.67.G01.1.454.CMB.2.raw
  modified_base (547)..(547): a, c, t, g, unknown or other
  modified_base (567)..(567): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcaccttagaagttatggatgacctggtccgccaggctccgaggggaggggctggagtggggtggccaacataaaacgaaagacggaaagtacaagaaaaaacctatagtaggactactggttagaccgggcccgtaatttccaaccctatcctaccaagagaaccaaacgcccaaagaaacttcacttgtaattttcgacaaaatgaaacagacccgttagaggacggacgggaaggaaccgaacgggccgtagtaagtttattgtgcgcgaggntgaactagtagacttccaanaaggtagactaggggtgtagtgtaactg

SEQ ID NO: 371686 - DNA, 576 bp, Homo sapiens
  misc_feature: GZ8MTXP02ICCTV.15.67.G01.1.454.CMB.2.raw
  modified_base (568)..(568): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggtcgggggggtccctggagactctctgtgcagtctctggattccacccttagaagttatggatgacctggtccgcaggctccgaggggagggctggaggtgggtggaccaaacaataaaacaaagaacggaaagtacaaagaaaaacctatagtagactctgtagaccgcgtatccgaccatctaccagacaacaaacgaccaaagtaattcaacttgttactttagacaaatacgaaacagacctgaagaggacggagacgacggcgtagttatagttgtagcgcgaagagtacgtagtagtacgacttacacgaagtacgacgtagggtgttaancgtaatgg

SEQ ID NO: 371687 - DNA, 549 bp, Homo sapiens
  misc_feature: GZ8MTXP02IUWIL.15.67.G01.1.454.CMB.2.raw
  modified_base (527)..(527): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttatggatgacctgggtccgccaggctccgaggggaaggggctggagtgggtggccaacataaacaaaggacggaagtacaagaaaaacctagtagtagactctgtagacgggccgattaccaccatctaccagacgaacaacgaccaaagattcacttgtatttagacaaatgaaacagcctaggagaggcggaggacacggcgtagtattatgtgcgtacgagatgatagtacgactcanaagtagacgtaggtgtatgatg

SEQ ID NO: 371688 - DNA, 555 bp, Homo sapiens
  misc_feature: GZ8MTXP02GR7BQ.15.67.G01.1.454.CMB.2.raw
  modified_base (528)..(528): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctggagactctcctgtgcagtctctggattcacccttagaagttattggatgacctgggtccgccaggctccgaggggaagggctggagtgggtggccaacaataaaacaaagacggaagtacaagaaaaacctagtagtaggactctgtagaccgggccgattcaccatctccaagagacaacgccaaagaattcactagtatttgactaaatgaaacagcctagagaggcggagacgacggccgtagtattattgtgcgtacgaggatagatagtacgactntacaagtagcgtaggtgtaatgagttg

SEQ ID NO: 371689 - DNA, 652 bp, Homo sapiens
  misc_feature: GZ8MTXP02GY960.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttgggtggagtcgtgggggaggcttgggtccgagggcccgggggggtccctgagactctcctgtgcagtctctggattccacccttagaagttatggatgacctgggtcccgccaggctccgaggggaaggggctgggagtgggtgaccaacaataaaacaaaggaacggaagtacaaaggaaaaacctatagtaggaacttcgtagtagacgggccgtattaccaaccatacctaccaagaacgaaaccgaaacgacccaaagtaacttacctaacttagttaatttagacctaaaagtacgaaaacacgtacccgtaggaaggagggacggaaggggaacctaacgggccgtagtaagtttagttggtcgccgacggaagataggtataaaggttacgaccttactaacgtaaggttaacggcgaagggttaggtaatcggtaaagtttcgg

SEQ ID NO: 371690 - DNA, 533 bp, Homo sapiens
  misc_feature: GZ8MTXP02FE0S7.15.67.G01.1.454.CMB.2.raw
  modified_base (376)..(376): a, c, t, g, unknown or other
  modified_base (379)..(379): a, c, t, g, unknown or other
  modified_base (387)..(387): a, c, t, g, unknown or other
  modified_base (402)..(402): a, c, t, g, unknown or other
  modified_base (405)..(405): a, c, t, g, unknown or other
  modified_base (408)..(408): a, c, t, g, unknown or other
  modified_base (428)..(428): a, c, t, g, unknown or other
  modified_base (486)..(486): a, c, t, g, unknown or other
  modified_base (504)..(504): a, c, t, g, unknown or other
  modified_base (527)..(527): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccgaggccggggggggtccctgagactctcctgtgcagtctctggattcacccttagaagttattggatgacctgggtccgccaggctccgaggggaagggctggagtggggtgccaaacataaaacaaagacgaagtcaagaaaaacctntgngactctgngacgccgattcaccntcncanagacaaacgcaagaatcacngtattgacaaatgaaacagcctagagaggcgaggaccacggccgtagtatatgtgcgngagatgatagtagacctntaacaagtaaggcgtaggtgtancgtatg

SEQ ID NO: 371691 - DNA, 554 bp, Homo sapiens
  misc_feature: GZ8MTXP02G7QSE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctggagactctcctgtgcagtctctggattcacccttagaagttatggatgacctgggtccgccaggctccgaggggaaggggctggagtgggtggccaacataaacaaagacggaagtacaagaaaaacctatgtggactctgtgacggcgattcaccatctccagagacaacgcaagatcactgtatttgactaaatgaaacacgccgtagaggaggacggaaggaccgacggccgtagtattagttgtgcgacgagatagtataggtacgactacgtacaaggtacgcgtaggtagtagtgtagttg

SEQ ID NO: 371692 - DNA, 527 bp, Homo sapiens
  misc_feature: GZ8MTXP02FS6M6.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagagttattggatgacctgggtccgccaggctccaggggaaggggctgggagtggggtggccaaacgataaacgaaagacggaagtcaagaaaaacctatgtggactctgtgacgggccgattcaccatctccagagacaacgcaaagattcactgtatttgcaaatgaaacagcctagagaggcgagacacggctgtatatgtgcgcgagatgatagtagactctacaagtagcgaggtgtatgattg

SEQ ID NO: 371693 - DNA, 542 bp, Homo sapiens
  misc_feature: GZ8MTXP02I6OBB.15.67.G01.1.454.CMB.2.raw
  modified_base (449)..(449): a, c, t, g, unknown or other
  modified_base (492)..(492): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagagttatggatgacctgggtccgccaggctccgaggggaaggggctgggagtgggtggaccaacataaaacaaagacggaagtacaagaaaaacctatagtggactcgtagtagacgggccattcaccatctccagagacacgaccaagattcactgtattgacaaatanaacagcctgagaggcggagacgacggcgtgtattattgcgcgngagatagatagtacgacttacaacaagtagacgtaggtgtagtcgtattg

SEQ ID NO: 371694 - DNA, 538 bp, Homo sapiens
  misc_feature: GZ8MTXP02I7FV5.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaagttatggatgacctgggtccgccaggctccgaggggaaggggctggagtggggtggccaaacataaaacaaagacggaagtcaagaaaaaccctatgtggactctagtgacgggccgattccaccatctacagagacaacgccaagaattcactgtatttgacaaatgaaacagcctagagaggcgagacacggccgtgtattagttgtgcgcgagatgatagtacgactctacaagtagacaggtggtatgatg

SEQ ID NO: 371695 - DNA, 644 bp, Homo sapiens
  misc_feature: GZ8MTXP02FO078.15.67.G01.1.454.CMB.2.raw
  modified_base (590)..(590): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttatttagaaggtgtccagtgtgaggtgcacgtttgggtgggaggttcggtggggggagggctttgggtccgagggcccgggggggtccctggagactctcctgtgcagtctcgtggtattccacccttagaagttattggatgaccgtgggtccgcaggctccgaggggaaggggctgggaggtggggtggccaaaacataaaacgaaaaggacggaagtacaaagaaaaacctagtggtagaacttcgtggtacggaaccgggccgtaatttaccaacccattaccacccaaggaaacgaacaaacccggacccaaagaaactttaccaacttgttaactttgaataaaagtgaaactacggcctagaggaggacgggaaggaccgaccggtaccgttagtaagtttagttggtggaccggnggagagtagataggtacgactactacaagtcgacgtagggtgtagtgatttcgg

SEQ ID NO: 371696 - DNA, 544 bp, Homo sapiens
  misc_feature: GZ8MTXP02JAFYV.15.67.G01.1.454.CMB.2.raw
  modified_base (495)..(495): a, c, t, g, unknown or other
  modified_base (497)..(497): a, c, t, g, unknown or other
  modified_base (499)..(499): a, c, t, g, unknown or other
  modified_base (504)..(504): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgactgggtccgccaggctccagggaaggggctggagtggggtggccaaacataaaacaaaagacggaagtacaagaaaaaacctatagtggaactctagtgacggggccaattccaccatctccagagacaaacgccaaagaattcactgtaatttgacaaaatgaaacagcctagagaggcgagacacggctgtatattgngngngagangatagtacgactactacgaagtagacgaggtagtatgatg

SEQ ID NO: 371697 - DNA, 568 bp, Homo sapiens
  misc_feature: GZ8MTXP02F4NJQ.15.67.G01.1.454.CMB.2.raw
  modified_base (331)..(331): a, c, t, g, unknown or other
  modified_base (421)..(421): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcgttgggtccgagggccggggggtccctggagactctcctgtgcagtctctggattcacccttagaagttattggatgacctggtccgcaggctccgaggggaagggcnggaggtgggtcggaccaaacataaaacgaaagacggaaagtacaaagaaaaacctatagtagacttcgtgtagaccgggccgattcaccntctccaagacgacaacgaccaaagaacttcactagttatttcgacaaatagaaacagcctaggagaggacggagacgacggcgtgtattagtgtgcgcgagatgaatagtagactctacaagtagacgaggtagtataggactttgg

SEQ ID NO: 371698 - DNA, 565 bp, Homo sapiens
  misc_feature: GZ8MTXP02IVRTK.15.67.G01.1.454.CMB.2.raw
  modified_base (302)..(302): a, c, t, g, unknown or other
  modified_base (344)..(344): a, c, t, g, unknown or other
  modified_base (388)..(388): a, c, t, g, unknown or other
  modified_base (412)..(412): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccgggggggtccctgagactctcctgtgcagtctctggattcacccttagaattatggatgacctggtccnccgaggctccgaggggaagggctgggagtggggtggccaaanataaaacaaaggacggaagtacaagaaaaaccctgtgtggactntgtgacgggcattcaccatctcanagacaacgacaagaatcactgttatttgacaaatgaaacacgcctagacggaggaccggaaggaccgaccggtcgtagttattagttgtgcggcgagataggaatagggtactactactacgtaagtacgacgaggtaggtagtgtacgttgg

SEQ ID NO: 371699 - DNA, 543 bp, Homo sapiens
  misc_feature: GZ8MTXP02F3D7T.15.67.G01.1.454.CMB.2.raw
  modified_base (387)..(387): a, c, t, g, unknown or other
  modified_base (483)..(483): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccggggggggtccctgagactctcctgtgcagtctctggattcacccttagaagttattggatgacctgggtccgccaggctccgagggaaggggctggagtggggtgccaaacataaaacaaagacggaagtacaagaaaaacctatgtggactntgtgacggccgattcaccatctccagagacaacgaccaaagaattcactgtatttgactaaaatgaaacagcctagagaggcgaggacacggccgngtatatgtgcgtcgagatgataggtacgaactcgtaacaagtagcgaggtgatggatttg

SEQ ID NO: 371700 - DNA, 561 bp, Homo sapiens
  misc_feature: GZ8MTXP02ILP1X.15.67.G01.1.454.CMB.2.raw
  modified_base (372)..(372): a, c, t, g, unknown or other
  modified_base (381)..(381): a, c, t, g, unknown or other
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtgggtgccaacataaacaaagacgaagtacagaaaaacctntgtggactntggtagacgggccgattcaccactctccagacgacaaccgccaaagaattcactgtatttagacaaatgaaacagcctagagagggacggaaggaccgtacgggaccgtagtatttagttgtgcgtacgagntagaatagtagaactctaacgaagtacgacgtaggtggtatggacttg

SEQ ID NO: 371701 - DNA, 558 bp, Homo sapiens
  misc_feature: GZ8MTXP02G2R2H.15.67.G01.1.454.CMB.2.raw
  modified_base (377)..(377): a, c, t, g, unknown or other
  modified_base (442)..(442): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtagtatttagaagtgtcagtgtgaggtgcacttggtggagtctgggggaggcttggtccagccgggggggtccctgagctctcctgtgcagtctctggattcacccttagaagttattggatgacctgggtccgccaggctccgaggggaagggctggagtgggtggccaacataaaacaaagacggaaagtacaagaaaaacctgagtggactntgtgacgggtccaattccaccatcacagagacaaacgccaaagtaatactactattatttagtanaaatagaacgacgacgagagaggacgagacgacggacgtagtattagttgtgcgacgagatagtagtagtacgtactactaacgtaacgtaagacgtaggtaggtagtagtagtag

SEQ ID NO: 371702 - DNA, 650 bp, Homo sapiens
  misc_feature: GZ8MTXP02IDIWR.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttatttagaaggtgtcagtgtgaggtgcacgttggtggagtcgtgggggaggcgttggtccgagggcccgggggggtccctggagactctcctgtgcagtctctggattcaccttagaagttattggatgaccgtggtccgcaggctccgaggggagggcgtgggaggtggggtacggaccaaacaaagtaaaacgaaaggacggaaagtacaaagtaaaaacctagtagtacggactcgtaggtacgaccgggccgtattcccactactctaccagaacgaacaacgtacccaagtaacttcacttgttatttagaactaaatgaaacagaccgtaggaaggacgggacgggaggaaccggtacgggtaccgttagttaagtttagttgggtacgaccggtacggagtagtagtaaaccgtaaggtaacgtacttaccgtaacgtaaggttacacggtaggtaggttagtaggttatttccgg

SEQ ID NO: 371703 - DNA, 535 bp, Homo sapiens
  misc_feature: GZ8MTXP02IYMZC.15.67.G01.1.454.CMB.2.raw
  modified_base (376)..(376): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagagttattggatgacctgggtccgccaggctccagggaaggggctggagtgggtggccaaacataaaacaaagacggaagtcaagaaaaacctntgtggactctgtgacggccattcaccatctccagagacaacgccaaagaattcactgtatttgacaaatgaaacagcctgagaggcgagacgacggcgtgtattattgtgcgacgagatgatagtacgactctacaagtagcaggtggtaactggattg

SEQ ID NO: 371704 - DNA, 606 bp, Homo sapiens
  misc_feature: GZ8MTXP02IS7QI.15.67.G01.1.454.CMB.2.raw
  modified_base (352)..(352): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcgtgggggaggcgttggtccgaggccggggggtccctggagactctcctgtgcagtctctggattcacccttagagttattggatgaccgtgggtcccgccgaggctccgaggggaagggctgggaggtgggtggaccaaaanaataaaacgaaaaggaacggaaagtacaaaagaaaaaccctagtgtaggaacttcgtggttacggaccgggccgtaattccgaacccatcctaccaagaacgaaaccaaacgacccaaaagtaacttcaacttagtatttagaactaaaatgaaactacgccgtagaggaggcggaagacacgggccgtagtattattgtgacgcgagatgaatagtacgtactctacgaagtacgcgtaggtgtatgtacttg

SEQ ID NO: 371705 - DNA, 544 bp, Homo sapiens
  misc_feature: GZ8MTXP02F14YI.15.67.G01.1.454.CMB.2.raw
  modified_base (517)..(517): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccggggggtccctgagactctcctgtgcagtctctggattcacccttagaagttattgggatgacctgggtccgccaggctccaggggaaggggctgggagtggggtggccaacgataaaacaaagacggaaagtcaaggaaaaacctatgtaggactctgtgacgggccgattcaccatctccagagacaacgcaaagattcactgtatttgacaaatgaaacagacctggagaggacgaaggacacggcgtagtattatgtgcgcgagatcggatacgtagactntacgaagtagcgaggtggtatgattcg

SEQ ID NO: 371706 - DNA, 585 bp, Homo sapiens
  misc_feature: GZ8MTXP02GUF5V.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggagactctcctgtgcagtctctggattcacccttagaagttattggatgacctgggtccgcaggctccgaggggaaggggctgggagtgggtggaccaaacataaaacaaagacggaaagtacaaagaaaaacctatgtaggaactcgtagtagaccggccgattaccaccatcctcagagaacaaacgccaaagattcactgttaatttgacaaaatagaaacagaccgtagaagagggacggaggaaaccgtacgggaccgttaggtattagttgtgcgcgagagtgaagtagtagacttctaacgaagttaagcggaggttgtagtagtagttcg

SEQ ID NO: 371707 - DNA, 549 bp, Homo sapiens
  misc_feature: GZ8MTXP02FXDIH.15.67.G01.1.454.CMB.2.raw
  modified_base (414)..(414): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccagggccgggggggtccctggagactctcctgtgcagtctctggattcacccttagagttatggatgacctggtccgcaggctccgaggggaagggctggagtgggtggaccaaacataaaacgaaagacggaagtacaagaaaaacctatgtagactctgtgacggcgattcaccatcaccaganacaacgccaaagatcactgttattagacaaatgaactagcctagagaggacgagacgacggccgtagtatagtgtgcgacgagtatgactagtacgtactactacgaagtagcgtaggtagtatagtagtttacg

SEQ ID NO: 371708 - DNA, 550 bp, Homo sapiens
  misc_feature: GZ8MTXP02JFR3L.15.67.G01.1.454.CMB.2.raw
  modified_base (344)..(344): a, c, t, g, unknown or other
  modified_base (496)..(496): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttatggatgacctgggtccgccgaggctccgaggggaagggcgtggagtggggtgccaaanataaaacgaaagacggaagtacaagaaaaacctatgtagactctgtgacggccgattcaccatctacagagaccaacgccaaagattcactgtattagacaaatgaaacagcctagagaggcgaggacaccgggcgtagtattagtgtgcgngagatgaagtagtacgacgtctaacgaaggtacgacgtagggtgtagtgatttg

SEQ ID NO: 371709 - DNA, 691 bp, Homo sapiens
  misc_feature: GZ8MTXP02JODSI.15.67.G01.1.454.CMB.2.raw
  modified_base (201)..(201): a, c, t, g, unknown or other
  modified_base (228)..(228): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgtatctgtagganacagagtcaccatcacgttggccgggnaagtcaggacattagactgacttaggtggtatcagcaagaaacgtccgggaaacgcccctaagcctcctgatctgtgctgcctactacctaactttaacgaaggtcggggtaccagttacgaaggtttccgacggtcggacgtaaggtcgggggaacttcggtacggaccaacgtacggttatttacccaccttaccttacccaaaccctacttacgacgtacgaccgcccgttgaccacggaccttagaaacgttacgtttacgacttaaactttacttaactacgttactaaacgtaaacgtaactttaacctaaaccgtttaccccgtaacgggtacccggtttaccgggaacccgggtaaacggggtaaacccggaaaggggtaacgtaaaaccgttaaccgaaaaccggtaacgttcgggtaaccggtcgttaaccggacctaaccgtactttaccgg

SEQ ID NO: 371710 - DNA, 576 bp, Homo sapiens
  misc_feature: GZ8MTXP02GT2RW.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccgaggcccgggggggtccctggagactctcctgtgcagtctctggattcacccttagaagttatggatgacctgggtccgccaggctccgaggggaaggggctgggaggtggggtcggccaaacgataaaacaaaaggaacggaaagtacaaagaaaaaacctatagtaggactctaggtagaaccgggccgattccaaccatacctccaagacgaacaaaccgccaaagattacactagtatttgactaaatgaaacagacctgagagggcgaggacacggccgtgtattagttacgtgcgtcgagatgatagtacgactctacgaagtagacgtaggtgtatgatg

SEQ ID NO: 371711 - DNA, 703 bp, Homo sapiens
  misc_feature: GZ8MTXP02JI7SD.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgagggcccgggggggtccctggagactctcctgtgcagtctctggattccacccttagaagttattggatgaccgtgggtcccgccaggctccgaggggaagggctgggagtgggtcggaccaaacaataaaacgaaaggacggaaagtacaaagaaaaacctagtggtagactcgtaggtacggaccgggccgaacttaccaacccacgttacctaccgaaaggaacgaaaccgaaacccgacccaaaagtaacttacctaacgttgttaatttagaacctaaaagttacgaaaaccgacgtaccgtaggaacgggaacgggaccgggaacgggaacccgacggggtacccgttaggttaacgtttagtttacggtacgtccggtacggaagagttaggtaaagttaacgtaacggtacctaacgtaaacgtaaggtaagtacggtaggggtagtagtacgggtactttcggg

SEQ ID NO: 371712 - DNA, 597 bp, Homo sapiens
  misc_feature: GZ8MTXP02GPNQO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggccgggggggtccctgagactctcctgtgcagtctctggattcacccttagaagttattggatgacctgggtccgccaggcctccgaggggaaggggctgggaggtggggtggaccaaacaataaaacgaaaaggaacggaaagtaccaaagaaaaacctatggtaggactcgtggtacgaccgggccgtaattccacccatcctaccaagacgaacaaaccgacaaagtaatcgactagttatttagactaaaatgaaacacgcctaggaggacggcgggaaggaccgacgggccgtagttattagttgtgcgagagatgaatagtacgactacgtacgaagtagacgtaggtgtatgacgttg

SEQ ID NO: 371713 - DNA, 532 bp, Homo sapiens
  misc_feature: GZ8MTXP02IOZA0.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtggggtggccaacataaaacaaaggacggaagtacagaaaaacctatgtggactctgtgacggccgattcaccatctccagagacaacgccaaagaattcactgtatttgacaaatgaaacagcctagagaggcgaggacacggcgtgtattatgtgcgcgagatgatagtagactctacaagtagacgaggtgtatgattg

SEQ ID NO: 371714 - DNA, 600 bp, Homo sapiens
  misc_feature: GZ8MTXP02H4SY5.15.67.G01.1.454.CMB.2.raw
  modified_base (266)..(266): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctntggattcacccttagaagttattggatgaccctgggtccgcgaggcctccgaggggaaggggctggaggtggggtggaccaaacaataaaaacgaaaaggacgggaaagtaccgaaagaaaaaactagtaggtaggactcgtaggtacggaaacgggccgtattccacctactcctaccagacgaacaaaccgacctaaagaactacacttagtatttagacaaatgaaacagtcctagagaggacgagggacacggcgtagtatgttacgtgcgagagagtagataggtacactactaacgaggtaagacgaggtagtagtgtagttagttcg

SEQ ID NO: 371715 - DNA, 590 bp, Homo sapiens
  misc_feature: GZ8MTXP02JQEWN.15.67.G01.1.454.CMB.2.raw
  modified_base (301)..(301): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagcgtggtttcgtgtagtatttagaagtgtcagtgtgaggtgcacttggtggagtcgtgggggagcttggtccaggccggggggtccctgagctctcctgtgcagtctcgtggattcacccttagaagttattggatgaccgtggtccgccgngcgccgagggaagggcgtggagtggtggacgaacaaaagaaacgaaagaacggaagtaacgaaagaaactagtagtagtacgtcgtgtacgacggcgtactacacactacacgacgacgacacgacgaacgtactactatagttattagtactaagacgaacgacgacgtagaggaggacggacggacgacggtacgtagttagttagttagtacgcgacgacgtagtagtacgtagtacgtacgtacgtacgagtaagacgtacggtacggtagtagtagtacgttcg

SEQ ID NO: 371716 - DNA, 567 bp, Homo sapiens
  misc_feature: GZ8MTXP02IWW5M.15.67.G01.1.454.CMB.2.raw
  modified_base (509)..(509): a, c, t, g, unknown or other
  modified_base (519)..(519): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcttggtccgaggcccgggggggtccctgagactctcctgtgcagtctctggattcaccttagaagttattggatgacctgggtccgccaggctccgaggggagggctgggagtgggtggccaacataaaacaaagacggaagtacaagaaaacctagtgtcgaactctggtagacgggccgtattccaccgatcctaccgaagacgaaccaaccgaccaaagtaacttcacttagtattagacaaatgaacagcctgagaggcggaagcgacggcgtaggtattagttgngcgtacgagnttgaatagtacgactcaagtaagtagacgtaggggtgtagtgtacttg

SEQ ID NO: 371717 - DNA, 548 bp, Homo sapiens
  misc_feature: GZ8MTXP02IKHTL.15.67.G01.1.454.CMB.2.raw
  modified_base (303)..(303): a, c, t, g, unknown or other
  modified_base (495)..(495): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaaggtgtccagtgtgaggtgcacttggtggagtctgggggaggcttggtccaggcccggggggggtccctgagactctcctgtgcagtctctggattcacccttagagttattggatgcctgggtccncaggctccaggggaaggggctgggagtgggtgccaacataaacaaagacggaatacaagaaaacctatgtggactctgtgacgggcattcaccatctccagacgacaacgccaaagaattcactgttatttgacaaaatgaaacagacctgacgaggacgaggacacggcgtgtaattagtgtgccgagagntgatagtagaaccttgtaacgaagttacgacgtaggttaggtatggactttgg

SEQ ID NO: 371718 - DNA, 553 bp, Homo sapiens
  misc_feature: GZ8MTXP02JXNLH.15.67.G01.1.454.CMB.2.raw
  modified_base (308)..(308): a, c, t, g, unknown or other
  modified_base (386)..(386): a, c, t, g, unknown or other
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggcccgggggggtccctggagactctcctgtgcagtctctggattcacccttagaagttattggatgacctgggtccnccaggctccgaggggaaggggctggagtgggtggaccaacaataaaacgaaagacggaaagtacaagaaaaaaccctntagtaggactctgtgaccggccgattcaccatctccagagacaacgaccaaagattcactgtatttgacaaatgaaacagacctgagaggcgagacacggctgtatatgtgcgtcgagatgagtacgtagactctaanaagtacgacgtaggtagtagtagtagtcg

SEQ ID NO: 371719 - DNA, 559 bp, Homo sapiens
  misc_feature: GZ8MTXP02HNCDE.15.67.G01.1.454.CMB.2.raw
  modified_base (347)..(347): a, c, t, g, unknown or other
  modified_base (426)..(426): a, c, t, g, unknown or other
  modified_base (511)..(511): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggattcacccttagaagttattggatgacctgggtccgccaggctccgaggggaagggctggagtgggtggccaaanataaaacaaagaacggaagtccaaagaaaaacctagtagtggaactctagtgacggccgattaccaccattcaccaganacaacgaccaagaatcactgtatttgactaaatgaaacagacctgagaggcgagacgacggacgtgtattagttgtgcgacgagntagagtagtacgactatacgaagtagacgtaggtaggtatgtatttcg

SEQ ID NO: 371720 - DNA, 548 bp, Homo sapiens
  misc_feature: GZ8MTXP02GNL3X.15.67.G01.1.454.CMB.2.raw
  modified_base (508)..(508): a, c, t, g, unknown or other
  modified_base (528)..(528): a, c, t, g, unknown or other
  modified_base (536)..(536): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttatggatgacctgggtccgcaggctccaggggaaggggctgggagtggggtggccaacataaaacaaagacggaatcaagaaaaacctatgtggactctgtagacgaccgattccaaccatctccaagagaacaaaccgccaaagaattcactgtatttgactaaaatgaaacagacctagagagggcgaaggaaccgacggccgtgtaattattgtgccgngaggatgatagtagactcanaagtacgngaggtgatgatg

SEQ ID NO: 371721 - DNA, 613 bp, Homo sapiens
  misc_feature: GZ8MTXP02F8MW8.15.67.G01.1.454.CMB.2.raw
  modified_base (380)..(380): a, c, t, g, unknown or other
  modified_base (412)..(412): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagttattggatgacctgggtccgccaggctccgaggggaagggctgggagtggggtggccaaacataaacgaaagacggaagtacaagaaaaacctntgtaggactctgtgacggccgattcaccatcncagagacaacgccaaagattacactgttatttagactaaaagtagaaacgagccgtagaaggaggacggaaggaaccgacgggacccgttagttaagtttagttggtacggaccggacggtaagagtacggaagttacgtaacggtaaccttactaaacgaacgttaaggacgtagggggtagttagtacggtagtttcgg

SEQ ID NO: 371722 - DNA, 607 bp, Homo sapiens
  misc_feature: GZ8MTXP02F4EET.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttgggtggagtcggtgggggaggcgttgggtccgagggcccggggggtccctggagactctcctgtgcagtctctggattcacccttagaagttattggatgacctgggtccgccaggctccgaggggaagggctggagtgggtggaccaacaataaaacaaaggaacggaagtacaaagaaaaaacctatagtaggaacttcgtagtaggaaccgggccgaattccaaccatctacccagaacgaacaaacgaccaaagaacttcactgttatttagacaaaatgaaacacgacctagaggaggacggaaggaccgacggccgtagtaatttagtgtagcgacgagatagaataggtacgtactactaacgaaggttacgacgtaggtaggtagtagtacgtttg

SEQ ID NO: 371723 - DNA, 533 bp, Homo sapiens
  misc_feature: GZ8MTXP02JGY2L.15.67.G01.1.454.CMB.2.raw
  modified_base (525)..(525): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccggggggggtccctgagactctcctgtgcagtctctggattcacccttagagttattggatgacctgggtccgccaggctccaggggaaggggctggagtgggtggccaacataaaacaaagacggaagtcaagaaaaacctagtgtggactctgtgacgggcgattcaccatctccagagacaacgccaagaattcactgtatttgacaaatgaaacagcctgagaggcgaggacacggccgtgtattagtgtgcgcgagatgatagtacgactcacaagtagcgaggtggtanggtattgg

SEQ ID NO: 371724 - DNA, 534 bp, Homo sapiens
  misc_feature: GZ8MTXP02FFAGA.15.67.G01.1.454.CMB.2.raw
  modified_base (380)..(380): a, c, t, g, unknown or other
  modified_base (391)..(391): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctggagtgggtggccaaacataaaacaaaagacggaaagtacaagaaaaaaccctntagtggactcngtgacgccgattcaccatctccagagacaaacgccaaagaattcactgtatttagcaaaatgaaacagcctgagaggcgagacacggccgtgtatatgtgcgcgagatgatagagactcgtaacaagtagcaggtgtatgatg

SEQ ID NO: 371725 - DNA, 682 bp, Homo sapiens
  misc_feature: GZ8MTXP02GV1U6.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgaccgtgggtccgccgaggctccgaggggaaggggctgggaggtggggtggccaaacaataaaacgaaaaggaacgggaaagtacgaaagaaaaaaccctagtaggtaggaacttcgtggttacggaaccgggtccgaatttccgaacccaactcctacccgaagaacgaaccgaaaccgaccaaaagtaaacttactaacttaggttaatttagaacctaaaagtacgaaacacgaccgtaggaaggacgggaccggaagggaacccgaccggtaccggttagttaagtttagttcggtggaccggacggaagtagttgaaacgttaaggtacgaacttacgtaaacgaaggtacgacggtaggggttaggtaagttggtaatttcgg

SEQ ID NO: 371726 - DNA, 560 bp, Homo sapiens
  misc_feature: GZ8MTXP02I3WOA.15.67.G01.1.454.CMB.2.raw
  modified_base (355)..(355): a, c, t, g, unknown or other
  modified_base (385)..(385): a, c, t, g, unknown or other
  modified_base (457)..(457): a, c, t, g, unknown or other
  modified_base (462)..(462): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcgttgggtccgaggcccgggggggtccctggagactctcctgtgcagtctctggattcacccttagaagttattggatgacctgggtccgccaggctccgaggggaagggctgggagtggggtggacccaaanataaaacaaagacgaagtcaagaaaacctngtgactctgtagacggcgattcacctatctccagacgacaacgaccaaagattacgactgtattgacaaatnaaacngctgagagcgagacgacggcgtagtattagttgtgcgtacgagagtagtatacggtagactcctaagaagtagtacgaggtaggtactaggtattcgg

SEQ ID NO: 371727 - DNA, 559 bp, Homo sapiens
  misc_feature: GZ8MTXP02IYPPG.15.67.G01.1.454.CMB.2.raw
  modified_base (452)..(452): a, c, t, g, unknown or other
  modified_base (466)..(466): a, c, t, g, unknown or other
  modified_base (507)..(507): a, c, t, g, unknown or other
  modified_base (516)..(516): a, c, t, g, unknown or other
  modified_base (544)..(544): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctggagactctcctgtgcagtctctggattcaccttagaagttattggatgaccgtgggtccgccaggctccgaggggaggggctggagtgggtggccaaacataaacaaagacggaagtacaagaaaaacctgtagtaggactcgtagtacgaccgggccgaattaccacctatcctaccgaagacgaacaaaccgaccaaagtaactnacttgtatttcganaaatgaaacagcctgagaggcgagacgacggcgtagtattntagtgacgngagatgataggtacactacacaagtacngaggttgtatgattg

SEQ ID NO: 371728 - DNA, 621 bp, Homo sapiens
  misc_feature: GZ8MTXP02HFMH6.15.67.G01.1.454.CMB.2.raw
  modified_base (323)..(323): a, c, t, g, unknown or other
  modified_base (329)..(329): a, c, t, g, unknown or other
  modified_base (343)..(343): a, c, t, g, unknown or other
  modified_base (542)..(542): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctggagactctcctgtgcagtctctggattcacccttagagttattggatgacctggtccgcgagctcgagggaggcgnggaggnggtcgaccaataanaaagaaagacggaatacgaaagaaactagtgtagactgtgacggacggccgtataccacactcctacgagacaaccgaaccgaaccaaagtaacttacgtaacgttagtttaacgtttagaaccttaaaagacgaaacgacgtaccgtagaaggacggacgggaaacgaccggaccggtcgtagtttaagttgttgggngacgtacggtagtagtagtaagttaacggtactaacgtacgtaagtaacgtagacggtaggtagtaggtagttacgttg

SEQ ID NO: 371729 - DNA, 564 bp, Homo sapiens
  misc_feature: GZ8MTXP02H02T7.15.67.G01.1.454.CMB.2.raw
  modified_base (457)..(457): a, c, t, g, unknown or other
  modified_base (497)..(497): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagttattggatgacctgggtccgccaggcctccgaggggaaggggcgtagggagtgggtggcccaaacaataaaacaaagacggaaagtacaagaaaaacctatgtaggactctgtagacggccgattccaccatctaccagagacaacgcaagatcactagtattgactaaangaaactgcctgagaggcgaggacacggcgtgtatgttagngcgcgagtatgaagtaacgtacgaacttctaacgaaggtacgacgagggttagtaatcggtaattgg

SEQ ID NO: 371730 - DNA, 626 bp, Homo sapiens
  misc_feature: GZ8MTXP02FZZMK.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttatttagaaggtgtccagtgtgaggtgcacttggtggagtcgtgggggagcttggtccaggccgggggggtcctgagactctcctgtgcagtctctggattcacccttagagttattggatgacctggtccgccaggctccgaggggaaggggctggaggtggtggccaaacgataaaacgaaaagacggaaagtacgaaagaaaaacctagtagtaggacttcgtgtaggaccgggccgaatttccaaccctatcctaccgaagacgaaaccaaaccggacccaaaaggaaactttacaaccgttagttaactttaggtaccaaaaagttagaaaaccgtacgacccgtagaacgagggacggaacggaccgaacggccgtagttagttacttgtgcgacgagatggataggtacgtaactctaagaacgttagacgtaggtggtaatggtacttg

SEQ ID NO: 371731 - DNA, 830 bp, Homo sapiens
  misc_feature: GZ8MTXP02JELKO.15.67.G01.1.454.CMB.2.raw
  modified_base (309)..(309): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggcccgggggggtccctggagactctcctgtgcagtctctggattccacccttagaagttattggatgacctgggtccnccaggctccgaggggaacgggctgggaggtggggtggaccaaacgaataaaacgaaaggacgggaaagtacaaagaaaaaaccctgtagtacgggaacttccgtggtacggaaccggggccgtaatttaccacccaattccgtacccaaaggaaacgaaaccgaaaacccgaccccgaaaaaggtaaactttaccctaaaccgtttacggtttaatttttacgggaaccctaaaaaagttacgggaaaaacccaacgggtacccccgttaagggaaacggggaacgggggaaccggggaaaaccggggaaacccggtacccgggggtaacccccggtttaaggggtttaaactttttaaacggtttgggttaacggggcccggttaacggggaaaacggtaaagtttacgggtaaaagttaagggttaaacgtaaaccgttaccgttaaacccggaaaggtttaaagggacccggtaaagggggtttagggttaaacgttcgggttaaaaccgttttcggg

SEQ ID NO: 371732 - DNA, 578 bp, Homo sapiens
  misc_feature: GZ8MTXP02IG34O.15.67.G01.1.454.CMB.2.raw
  modified_base (303)..(303): a, c, t, g, unknown or other
  modified_base (322)..(322): a, c, t, g, unknown or other
  modified_base (375)..(375): a, c, t, g, unknown or other
  modified_base (531)..(531): a, c, t, g, unknown or other
  modified_base (535)..(535): a, c, t, g, unknown or other
  modified_base (540)..(540): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttattttagaggtgtccagtgtgaggtgcacttggtggagtcgtgggggaggcttggtccaggcccggggggtccctgagactctcctgtgcagtctctggattcacccttagaagttattggatgacctgggtccncaggctccgaggggagggntggagtgggtggaccaaacataaaacaaaggacggaagtacaagaaaaacctntagtaggactgtgtacgaccgggacctattccacctatcctaccagaacgaacaaaccgaccaaaagtaacgttacaacttgttaatttagactaaaatagaaacagtaccgtagaggaggcggacggacgacggaccgtgtacttagttgtgcgngagnagtanagtacactatacaagtagcgtaggtgtagtagtagtcg

SEQ ID NO: 371733 - DNA, 561 bp, Homo sapiens
  misc_feature: GZ8MTXP02GXJDL.15.67.G01.1.454.CMB.2.raw
  modified_base (301)..(301): a, c, t, g, unknown or other
  modified_base (407)..(407): a, c, t, g, unknown or other
  modified_base (434)..(434): a, c, t, g, unknown or other
  modified_base (440)..(440): a, c, t, g, unknown or other
  modified_base (442)..(442): a, c, t, g, unknown or other
  modified_base (445)..(445): a, c, t, g, unknown or other
  modified_base (447)..(447): a, c, t, g, unknown or other
  modified_base (449)..(449): a, c, t, g, unknown or other
  modified_base (451)..(451): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttctgttagttatttagaaggtgtccagtgtgaggtgcacttggtggagtctgggggagcttggtccaggccgggggggtccctgagactctcctgtgcagtctctggattcacccttagaagttattggatgacctgggtccnccaggctccaggggaagggctggagtggtggcaacataaaacaaagacggaagtacaagaaaaacctagtagtaggactgtagagaaccgggccaattcaccatcncagagacaacgaccaaagtaatacatntattananaananananacgagagagacgacgacgacgacgtagtattatgtgacgacgagagtagtaagtaacgtacgtacgtacgtaacgtaacgtacgtacgtacggtaggtagtagtagtacg

SEQ ID NO: 371734 - DNA, 733 bp, Homo sapiens
  misc_feature: GZ8MTXP02G7QZD.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggaggttggggctgagctgggttttccttgttgttattttagaaggtgtccagtgtgaggtgcacgttgggtgggaggttcggtggggggaggtcgttgggtccgacggggccccggggggggtccctggacgtaccttcctccgttgtcgcagtctcgtggattccacccttagaagttattggatgacctgggtccgccaggctccgaggggaagggcgtgggaggtggggtcggaccgaaacaagtaaaacgaaaggaaccggaagtacaaagaaaaacctagtgtaggacttcgtaggtacggaccggtccgaatttcccgaaaccctagttccgtaccaaggaacgaaaccaaaacccggaccctaaaaggaaactttaccgaacttcggttaaattttacggaacctaaaagttaggaaaacgaccgtaccgttaagggaagggacgggacggggaaacggaccgggtaaccggggtaccggttaggttaactttaggttacggtggtaccggacggtagagtcggtaaagtacggttaacgaacttccgtagtaaggtacgacggtacgggtggttagtaggtagtttagg

SEQ ID NO: 371735 - DNA, 554 bp, Homo sapiens
  misc_feature: GZ8MTXP02HB00G.15.67.G01.1.454.CMB.2.raw
  modified_base (380)..(380): a, c, t, g, unknown or other
  modified_base (409)..(409): a, c, t, g, unknown or other
  modified_base (414)..(414): a, c, t, g, unknown or other
  modified_base (439)..(439): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattccacccttagaagttatggatgacctggtccgccaggctccgaggggaagggctggaggtgggtggaccaaacaataaaacgaaagacggaagtacaagaaaaacctntgtgactctgtagacggcatccaccatcncaganacaacgacaagatcactgtattganaaatgaaacagcctagagagggacggacggacgacgggcgtagttaattgtagtgcgacgagtagtgaatagtacgactactacaaggtacgacgtaggtagtagtgtagtttgg

SEQ ID NO: 371736 - DNA, 569 bp, Homo sapiens
  misc_feature: GZ8MTXP02I9B7I.15.67.G01.1.454.CMB.2.raw
  modified_base (419)..(419): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagttcgtgggggaggctttggtcccgaggcccgggggggtccctgagactctcctgtgcagtctctggattcacccttagagttattggatgacctgggtccgccaggctccaggggaaggggctggagtggggtggccaacataaaacaaagacggaagtacaagaaaaacctagtgtggactctgtgacggccgattcaccatctccaganacaacgccaaagatacactgtatttgactaaaatgaaacagcctagagaggcgaaggacgacggcctagtattagttgtgcgcggtanatgaagttagtagaacttcgtaaccaaggttacgacggtaaggtggtaagtcggtaatttgg

SEQ ID NO: 371737 - DNA, 536 bp, Homo sapiens
  misc_feature: GZ8MTXP02I8C8I.15.67.G01.1.454.CMB.2.raw
  modified_base (376)..(376): a, c, t, g, unknown or other
  modified_base (403)..(403): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggagggctgggagtggggtggccaaacataaaacaaagacggaagtcaagaaaaacctangtgactctgtgacggcgatcaccatcnccagagacaacgccaaagaattcactgtatttgacaaatgaaacagcctagagaggcgaggacgacggccgtagtattagtcgtagcgacgagatgaatagtagactctaacaagtagctaggtgtatgattg

SEQ ID NO: 371738 - DNA, 605 bp, Homo sapiens
  misc_feature: GZ8MTXP02GSFLR.15.67.G01.1.454.CMB.2.raw
  modified_base (204)..(204): a, c, t, g, unknown or other
  modified_base (307)..(307): a, c, t, g, unknown or other
  modified_base (328)..(328): a, c, t, g, unknown or other
  modified_base (346)..(346): a, c, t, g, unknown or other
  modified_base (382)..(382): a, c, t, g, unknown or other
  modified_base (581)..(581): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggnggagtcgtgggggagcttggtccaggccgggggggtccctgagactctcctgtgcagtctcgtggtacttcacccttagaagttattggatgactgggtcccncgaggctccgaggggagggcnggaggtgggtgaccaaanataaaacgaaagacggaaagtacaaagaaaaacctntgaggactgtgtagaccggcgattccaacctatctaccagaacgaaccgaaccgaaccaaagtaacttcaaccttggttaatttagaacctaaaatacggaaacacgccgtaggaggaggcggaaaggaccgacggcgttagtagtttagtgtaggccggtagagtaatgaatacggtaactacctgtaacaagtacgngaggggttggtaatcggtatttgg

SEQ ID NO: 371739 - DNA, 568 bp, Homo sapiens
  misc_feature: GZ8MTXP02JWXJJ.15.67.G01.1.454.CMB.2.raw
  modified_base (342)..(342): a, c, t, g, unknown or other
  modified_base (420)..(420): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgacgactctcctgtgcagtctctggattcacccttagaagttattggatgactggtccgccaggctccgagggagggctggaggtggtggaccaanaataaacaaagacggaagtcaagaaaaaccctatgtaggactcgtgtaggacggcccgaattcacccatctaccaganaacaacgacaaagattcactgtattgacaaatgaaacagcctagacgagggcgaggaccacggcgtgtattagttgtgacggcgagagtagtagtaacgtacgtacgtactacgtaacgtacggtacggtaggtaggtagtagtagtg

SEQ ID NO: 371740 - DNA, 680 bp, Homo sapiens
  misc_feature: GZ8MTXP02GQCG1.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctggagactctcctgtgcagtctctggattcacccttagaagttattggatgaccgtgggtccgccaggctccgaggggaagggctgggagtgggtggaccaaacgaataaaacgaaaggaacgggaaagtaccaaaagaaaaaacctagtagtaggacctcgtggtagaccggggccctaattccaaccctatcctacccgaaagaacgaaccaaaccggacccaaaagaattacaactgttaatttgaactaaaatgaaaacagtaccgtaggaagacgggacggaacggaaccgaaccgggaccgttagttaactttagttaggttcgaccggtacggagtagttaggaaacgttaaggtacgtaaccttaccgttaaacgaaggttaacggtacgtaaaggggtttaggttaagttacgggtaacttttcggg

SEQ ID NO: 371741 - DNA, 561 bp, Homo sapiens
  misc_feature: GZ8MTXP02JSKE3.15.67.G01.1.454.CMB.2.raw
  modified_base (387)..(387): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggtccctgagactctcctgtgcagtctctggattcacccttagaagttattggatgacctgggtccgccaggctccgaggggaaggggctgggaggtgggtggaccaaacaataaaacaaaggaacggaaagtaccaaagaaaaacctntgtaggactctgtgacggccgattccaccatcctccagacacaacgccaaagatcactgtatttgacaaatgaaacagacctagagaggacgaggaccgacggccgttgtattagtgtgcgtacgagagtgagtagtacgactctaacgaagtacgagaggtgtatagatttgg

SEQ ID NO: 371742 - DNA, 572 bp, Homo sapiens
  misc_feature: GZ8MTXP02G42KY.15.67.G01.1.454.CMB.2.raw
  modified_base (429)..(429): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaagggctggagtgggtggccaacataaaacaaagacggaaagtcaaagaaaaaaccctatagtaggaactcgtagtaggaaccggccgaattccaaccatctaccaaganaacaaacgccaaagaattacactgtaatttgacaaatagaaacagacctaggaagagggacgaaggacgaacgggccgtaggtaattagttgtgcgcgagatgatagacgactctaacaagtacgacgaggtgtatgacttgg

SEQ ID NO: 371743 - DNA, 544 bp, Homo sapiens
  misc_feature: GZ8MTXP02IFFSL.15.67.G01.1.454.CMB.2.raw
  modified_base (306)..(306): a, c, t, g, unknown or other
  modified_base (340)..(340): a, c, t, g, unknown or other
  modified_base (412)..(412): a, c, t, g, unknown or other
  modified_base (498)..(498): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggagactctcctgtgcagtctctggattcacccttagaagttatggatgacctgggtccncaggctccgaggggagggctggagtgggtgcaanataaacaaagacggaagtacaagaaaaacctatagtggactcgtagtgacgggccattccaccatctcaganacaacaccaagatcatcgtatttgactaaatgaaacagccgtagaagaggacggaggacgacggcgtagtattagtgtgcgcgagntagatagtacgactactacaagtacgacgaggtagtagtagtattg

SEQ ID NO: 371744 - DNA, 650 bp, Homo sapiens
  misc_feature: GZ8MTXP02GO0G8.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccaggccggggggtccctgacgactctcctgtgcagtctctggattcacccttagaagttattggatgaccgtggtcccgccaggcctccgagggggaggggcgtgggaggtggggtcggacccaaaacgaagtaaaacgaaaagacgggaaagtacaaagaaaaacctagtaggtaggaactcgtagttacggaccgggccctaattaccgaccctatcccgtacccaaaggacgaaacaaacccgacccaaacgaacttacctactagttaatttagacctaaaagtacgtaaaacgacgtaccctagggaagagggaccggaaggaaccgacgggccgttaggtatttagtgtacgcggacgtaagagtagtataaggtacactacttaacgaagtagacgaggtagtagtacgagtttg

SEQ ID NO: 371745 - DNA, 554 bp, Homo sapiens
  misc_feature: GZ8MTXP02GYPE1.15.67.G01.1.454.CMB.2.raw
  modified_base (305)..(305): a, c, t, g, unknown or other
  modified_base (414)..(414): a, c, t, g, unknown or other
  modified_base (449)..(449): a, c, t, g, unknown or other
  modified_base (454)..(454): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctcgggtccnccaggctccaggggaagggctggagtgggtggccaaacataaaacaaagacggaaagtacgaaagaaaaacctatagtggactcgtgtacgacgggccattcaccatcncagacacaacgcaagatcactgtattgacaaagtnaaacngcctagaggagacgaggacgcggtacgtgtattagttgtggcgcgagatagagttagtacgactcgtaacgaagtacgacaagggtgtaagtcgagtttg

SEQ ID NO: 371746 - DNA, 582 bp, Homo sapiens
  misc_feature: GZ8MTXP02IEX4U.15.67.G01.1.454.CMB.2.raw
  modified_base (348)..(348): a, c, t, g, unknown or other
  modified_base (388)..(388): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggattcacccttagaagttatggatgacctgggtccgccaggctccgaggggaaggggctgggagtgggtggccaaanataaacaaagacggaagtcaagaaaacctatgtaggactntgtgacggccgattcaccatctcagagacaacgaccaagaatcactgttattgacaaatgaaacagccctagaaggacgggacggaggaccgaacgggtccgtgttaatttagtgtagcgtacgagtatagaaattacggtaagaccttctaaacgaaggttaacgacgtagggtaggttactaggtacttcgg

SEQ ID NO: 371747 - DNA, 639 bp, Homo sapiens
  misc_feature: GZ8MTXP02H3ZE9.15.67.G01.1.454.CMB.2.raw
  modified_base (354)..(354): a, c, t, g, unknown or other
  modified_base (566)..(566): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggaggtcgtgggggaggcgttggtccgagggcccggggggtccctgagactctcctgtgcagtctctggattcacccttagaagttattggatgaccgtgggtccgccgaggctccgaggggaagggcgtggaggtgggtggaccaaanaataaaacaaaaggacggaaagtacaaagaaaaaacctagtagtaggaacttcgtaggttacgacgggtccgaatttaccaaccaacgtcctacccaaagaacgaaaccaaaccgtacccaaaagaaacttctaacttagttaatttagaactaaagtagaaacagccctaggagaggcggaaggacgacgggaccgttagtattaattggngtacggcgaagatagagtaagtacgacgttacctagaagttacgaacgtagggtaggtagtacgtaagtttgg

SEQ ID NO: 371748 - DNA, 550 bp, Homo sapiens
  misc_feature: GZ8MTXP02JOE8D.15.67.G01.1.454.CMB.2.raw
  modified_base (380)..(380): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctgggtccgcaggctccgaggggaaggggctgggaggtggggtggaccaaacataaaacaaaggacggaatcaaagaaaaacctntgtgactctgtgaccggcgattcaccatctccagagacaacgacccaaagattcactgtatttagacaaatagaaacagacctggagaggcggaaggacgacggccgtagtattatgtgcgtcgagatgatagtagactctaacaagtacgcgtaaggtgtactagattg

SEQ ID NO: 371749 - DNA, 573 bp, Homo sapiens
  misc_feature: GZ8MTXP02GXXQ3.15.67.G01.1.454.CMB.2.raw
  modified_base (341)..(341): a, c, t, g, unknown or other
  modified_base (472)..(472): a, c, t, g, unknown or other
  modified_base (511)..(511): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggagcttggtccaggccgggggggtccctgagactctcctgtgcagtctctggattcacccttagaagttattggatgacctgggtccgccaggctccgaggggagggctggagtgggtggccaaanataaaacgaaagacggaagtcaagaaaaacctatgtaggactcgtaggtagaccgggccgaattcgaaccaatctaccgaagacgacaaaccgaccaaagaacttcactagtatttagacaaatagaaacngacctgaagagggcgagacgacggcgtagtattattggngcgacgagatagtaagtagtacgactactagaagtacgtacggaggttgtagtagtacgttg

SEQ ID NO: 371750 - DNA, 583 bp, Homo sapiens
  misc_feature: GZ8MTXP02JMLVM.15.67.G01.1.454.CMB.2.raw
  modified_base (489)..(489): a, c, t, g, unknown or other
  modified_base (523)..(523): a, c, t, g, unknown or other
  modified_base (529)..(530): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggcccgggggggtccctggagactctcctgtgcagtctctggattcacccttagagttattggatgacctgggtccgcaggctccgaggggaggggctgggaggtggggtggaccaaacataaaacaaaggacggaaagtcaagaaaaaaccctgtgtagggactcgtaggtgaaccgggcgaacttcaccctagtcctaccagaacgaccaaacgacccaaagaacttccatgttatttagacaaatagaaacagccngagaggcgaagcgacggcgtagtattagtgtcgngcgagnngagtagtacgtactacgtacgtaagtacgtacgtacggtaggtagtagtagtg

SEQ ID NO: 371751 - DNA, 552 bp, Homo sapiens
  misc_feature: GZ8MTXP02IP0B6.15.67.G01.1.454.CMB.2.raw
  modified_base (342)..(342): a, c, t, g, unknown or other
  modified_base (375)..(375): a, c, t, g, unknown or other
  modified_base (523)..(523): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccgggggggtccctgagactctcctgtgcagtctctggattcacccttagaagttattggatgacctgggtccgccaggctccgaggggaggggctggagtgggtggccaanataaaacaaagacggaagtacaagaaaaacctntgtgactctgtgacgggcgattccgacctatctaccagacgacaacgccaaagaattacactgtatttgactaaactgaaacagcctagagacggcgagacgacggcgtagtattattgtgcgtcgagatggataggtacgactctanaagtacgacgtaggtagtatgtaacgttg

SEQ ID NO: 371752 - DNA, 550 bp, Homo sapiens
  misc_feature: GZ8MTXP02FPLVU.15.67.G01.1.454.CMB.2.raw
  modified_base (545)..(545): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttatggatgacctgggtccgccaggctccgaggggaaggggctggagtgggtggccaaacataaaacaaagacggaagtacaagaaaaacctatgtaggactctgtagacggccgattcaccatctccagagacaacgaccaaagaattcactgtatttgacaaatgaaacagaccgtagaagagggacggaaggacgacggccgtagtattagttgtgcgcgagatagatacgtagactctacaagtagcgaggtgtangattg

SEQ ID NO: 371753 - DNA, 613 bp, Homo sapiens
  misc_feature: GZ8MTXP02FQ8RJ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtggggtcggccaaacataaaacgaaaggacggaaagtacaaggaaaaaacctagtgtaggacttcgtgtaggaaccgggccgatttcaacctatcctaccagaacgacaaaccgaccgaaagaacttcgactgttaattgacaaaatgaaactagcctaggagagggacggaaggaccgacgggtacccgtagttaagtttagttgtgccggacggagataggaagttaacgtacgtacctacgtacaaggttagacgtagggttgtaacgtggtatttg

SEQ ID NO: 371754 - DNA, 543 bp, Homo sapiens
  misc_feature: GZ8MTXP02FJWJE.15.67.G01.1.454.CMB.2.raw
  modified_base (267)..(267): a, c, t, g, unknown or other
  modified_base (303)..(303): a, c, t, g, unknown or other
  modified_base (378)..(378): a, c, t, g, unknown or other
  modified_base (388)..(388): a, c, t, g, unknown or other
  modified_base (406)..(406): a, c, t, g, unknown or other
  modified_base (412)..(412): a, c, t, g, unknown or other
  modified_base (414)..(414): a, c, t, g, unknown or other
  modified_base (424)..(424): a, c, t, g, unknown or other
  modified_base (430)..(430): a, c, t, g, unknown or other
  modified_base (440)..(440): a, c, t, g, unknown or other
  modified_base (446)..(446): a, c, t, g, unknown or other
  modified_base (536)..(536): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtgagtctgggggaggcttggtccaggccggggggggttccctgagactctcctgtgcagtctcnggattcacccttagagttatggatgacctgggtccncaggctccgaggggaaggggctgggagtgggtggaccaaacataaaacaaaggacggaatcaagaaaaacccctntagtgactcngtgacgccgattcacctntcacananacacgacaanatcatntatagacaancgaacngtcagagaggacgacgtaccgacggtcgtagtatagtgtgcgacgtagatagaactacgtacgactacacgaagtacgacgtaggtgtancgtagtg

SEQ ID NO: 371755 - DNA, 555 bp, Homo sapiens
  misc_feature: GZ8MTXP02HOL4B.15.67.G01.1.454.CMB.2.raw
  modified_base (380)..(380): a, c, t, g, unknown or other
  modified_base (449)..(449): a, c, t, g, unknown or other
  modified_base (451)..(451): a, c, t, g, unknown or other
  modified_base (453)..(453): a, c, t, g, unknown or other
  modified_base (455)..(455): a, c, t, g, unknown or other
  modified_base (457)..(457): a, c, t, g, unknown or other
  modified_base (459)..(459): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtctgggggaggcttggtccaggcccgggggggtccctgagactctcctgtgcagtctctggattcacccttagaagttatggatgacctgggtccgcaggctccgaggggaagggctggagtgggtggccaaacgataaaacaaagacggtaaagtcaaagaaaaaacctntgtggactctgtgacgggccaattcacccatctccagagacaacgccaaagaattcaactgtattgaananananancngagagagagacgacgcgtgtagtagtgtgcgacgagagtagtagtacgtacgtacgtacgtacgtaagtacgtacgtacggtaggtagtagtagtg

SEQ ID NO: 371756 - DNA, 583 bp, Homo sapiens
  misc_feature: GZ8MTXP02HBXIJ.15.67.G01.1.454.CMB.2.raw
  modified_base (374)..(374): a, c, t, g, unknown or other
  modified_base (402)..(402): a, c, t, g, unknown or other
  modified_base (408)..(408): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagaagttatggatgacctggtccgccaggctccgaggggaggggctggagtgggtggccaacataaaacaaagacggaagacaagaaaaacctngtggactctgtgacggcgatcaccatcnccaganacaacgcaagatcactgtatttagacaaaatgaaacacgaccctaggaagacgggacggaaggaccgaacgggacccgttaggtaatttaagttgtcgccgacggtagatgaagttaacgtaggtaacctttacgaacaaggtaacgacggtaggtagttaagtggtaactttgg

SEQ ID NO: 371757 - DNA, 550 bp, Homo sapiens
  misc_feature: GZ8MTXP02J1DC8.15.67.G01.1.454.CMB.2.raw
  modified_base (306)..(306): a, c, t, g, unknown or other
  modified_base (376)..(376): a, c, t, g, unknown or other
  modified_base (503)..(503): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccgggggggtccctgagactctcctgtgcagtctctggattcacccttagaagttattggatgacctgggtccncaggctccaggggaaggggctgggagtggggtggccaacataaacaaagacggaagtcaagaaaaacctntgtaggactctgtgacggcgatcacatctcagagacaacgaccaaagattcactgtaatttgacaaatgaaacaggcctagacgaggcggaaggtacacgggtccgtgtattatgtagcgacgaganaggacttaggacgactctagaagtacgcgaggttgtagtacgattgg

SEQ ID NO: 371758 - DNA, 597 bp, Homo sapiens
  misc_feature: GZ8MTXP02GDY6H.15.67.G01.1.454.CMB.2.raw
  modified_base (264)..(264): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcgttggtccgagggccggggggtccctgagactctcctgtgcngtctctggattcacccttagaagttattggatgacctgggtccgccaggctccgaggggaacgggctgggaggtggggtcggaccaaaacaataaaacgaaaagacggaaagtacaaaggaaaaaacctatgtacggactctaggtagaccgggccgaattccgaaccatctacccgaagaacgaacaaaccgtaccaaaagaacttcaactgttaatttgacaaaatgaaacagacctaggagacggacgaaggaccgacggtccgtagttagttagttgtgcgacgtagatagatagtacgactctaagaagtagcgtaggtgatgatttg

SEQ ID NO: 371759 - DNA, 699 bp, Homo sapiens
  misc_feature: GZ8MTXP02FTS13.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcgttgggtccgacgggcccgggggggttccctggacgacttctcctgtgcagtctcgtggattcacccttagaagttattggatgacctggtccgccaggctccgaggggagggctggagtgggtggaccaaacaataaacgaaagacggaagtacgaaagaaaaaccctgtagtagggacttcgtaggttacggaccggggcctaacttccgaaccctatcctacccgaagaacgaacgaaaccggacccaaaaggtaacttcaacttagtttactttagaactaaaagtcgaaaccgtacgacctaggaaggagggaccggaaacgggacccgtacggggtaccgttaggtttaacgtttagttcggtacggtccgacggtaaggtagttacggaaagttacggtaacgtaaccttacgttaaaccgaaggtttaacggacgtaaggggttaggttaaagtcggtagttttaacgg

SEQ ID NO: 371760 - DNA, 564 bp, Homo sapiens
  misc_feature: GZ8MTXP02GPBYE.15.67.G01.1.454.CMB.2.raw
  modified_base (376)..(376): a, c, t, g, unknown or other
  modified_base (415)..(415): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccctagagttatggatgacctgggtccgccaggctccgaggggaaggggctggagtggggtggccaagataaacaaaagacggaagtacgaagaaaaacctntagtggactctgtagacggccgattcaccatctccaganacaacgccaagaattcacttgtatttgacaaatgaaacagcctagaggaggcgaggacacggaccgtgtagttattgtgcgacggagatggaataggtaacgtactacgttacaaggttacgcgtaggtaggttacgtagtacgtttgg

SEQ ID NO: 371761 - DNA, 560 bp, Homo sapiens
  misc_feature: GZ8MTXP02IZ7JW.15.67.G01.1.454.CMB.2.raw
  modified_base (411)..(411): a, c, t, g, unknown or other
  modified_base (510)..(510): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggcccgggggggtccctgagactctcctgtgcagtctctggattcacccttagaagttattggatgacctgggtccgccaggctccgaggggaaggggctggaggtgggtggccaaacataaacaaagacggaagtacaagaaaaacctatgtaggactctgtgacgggccgattccaccntctccagagacaaccgccaaagaattcactgttatttgacaaatgaaacagcctaggagagggacggaggaaccgacggcgtggtaattagttgtgcgngagatgatagtacgactctaacaagtagcgtaagggtggtatgtagtttg

SEQ ID NO: 371762 - DNA, 644 bp, Homo sapiens
  misc_feature: GZ8MTXP02HZTM7.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttatttagaaggtgtccagtgtgaggtgcacttggtggagtcgtgggggaggcttggtccgaggcccgggggggtccctggagactctcctgtgcagtctctggattccacccttagaagttattggatgacctgggtccgccgaggctccgaggggaggggctgggaggtgggtggaccaaacaataaaacgaaagaacggaagtacaaagaaaaacctagtgtggaactcgtgtacgacgggccgaattccgaaccctatcctaccaagacgaaccaaaccgacccaaaagaacttaccgaacttacgttaatttacgaactaaaagtacggaaacctacgacccgttaggaagaacggggaccggaagggaaccgacgggtaccggttagtaactttagtggtgcggtacgaagtatagaaagtagtaacgacttacgaacgtaagtacgacgtaggggttagtagtgtacgttg

SEQ ID NO: 371763 - DNA, 549 bp, Homo sapiens
  misc_feature: GZ8MTXP02H7YFP.15.67.G01.1.454.CMB.2.raw
  modified_base (503)..(503): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcacccttagagttattggatgacctgggtccgccaggctccgaggggaagggctggagtgggtggccaacataaacaaagacggaagtacaagaaaacctatgtggactcgtgtgacgggccgattccaccatctaccagagacaaacgccaaagaattcactgtatttgacaaatgaaacagcctagagaggcggaggacgacggcgtgtattagttgtgcgacgagngtgaagtagtacgactcgtaacaagtacgagaggtgagtgagtttg

SEQ ID NO: 371764 - DNA, 538 bp, Homo sapiens
  misc_feature: GZ8MTXP02HL541.15.67.G01.1.454.CMB.2.raw
  modified_base (347)..(347): a, c, t, g, unknown or other
  modified_base (413)..(413): a, c, t, g, unknown or other
  modified_base (515)..(515): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggcccggggggggtccctgagactctcctgtgcagtctctggattcacccttagaagttattggatgacctgggtcccgccaggctccgaggggaaggggctggagtggggtggccaanataaaacaaagaacggaagtacaagaaaaacctatgtggactctgtgacgggccgattcaccatcnccagagacaacgacaagaatcactgtattgacaaatgaacacgcctagagaggcgagacgacggctgtatatgtgcgcgagatagatagtacgactacctanaagtagcgaggtagtatcgattg

SEQ ID NO: 371765 - DNA, 569 bp, Homo sapiens
  misc_feature: GZ8MTXP02ICIN6.15.67.G01.1.454.CMB.2.raw
  modified_base (514)..(514): a, c, t, g, unknown or other
  modified_base (521)..(521): a, c, t, g, unknown or other
  modified_base (523)..(523): a, c, t, g, unknown or other
  modified_base (562)..(562): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttatttagtaaggtgtcagtgtgaggtgcacttggtggagtcgtgggggagggcttggtccgaggccggggggtcccgtgagactctcctgtgcagtctctggatctacccttagtaagttattggatgaccgtcgggtccgccacggctccgaggggaagggcgtggaggtgggtggccaaacataaacaaagaacggagtacaagaaaaacctaatgtggactctggtacgacgggacccgtacttaccgaccactctcccaagaagacaaaccgaccaaagaattccactgttatttgacaaatgaaacagctgagaggccgaaggctacggcgtgtattattgngcgaganangatagtacgaactctaacaaggttacgacgtggtaggtntgattgg

SEQ ID NO: 371766 - DNA, 577 bp, Homo sapiens
  misc_feature: GZ8MTXP02G4CNY.15.67.G01.1.454.CMB.2.raw
  modified_base (347)..(347): a, c, t, g, unknown or other
  modified_base (380)..(380): a, c, t, g, unknown or other
  modified_base (392)..(392): a, c, t, g, unknown or other
  modified_base (411)..(411): a, c, t, g, unknown or other
  modified_base (416)..(416): a, c, t, g, unknown or other
  modified_base (422)..(422): a, c, t, g, unknown or other
  modified_base (448)..(448): a, c, t, g, unknown or other
  modified_base (542)..(542): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttgggtccgagggcccgggggggtccctgagactctcctgtgcagtctctggattcacccttagaagttattggatgacctgggtccgcaggctccgaggggagggctggagtgggtggccaanataaacaaagaacggaagtacaagaaaaacctntgtggactctgngacggcgattccaccatcncaganacaacnccaagatcactgtatttagacaaatnaaactagccgtagaggagggcggaaggaccgacggaccgttgtattagttgtgcggtacgagtagtaggaaacttaggttacgacttacgtaanaaggttacgacgtagggtaggtactaggatttcgg

SEQ ID NO: 371767 - DNA, 595 bp, Homo sapiens
  misc_feature: GZ8MTXP02GYEYO.15.67.G01.1.454.CMB.2.raw
  modified_base (426)..(426): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattccacccttagaagttattggatgacctggggtcccgccaggctccgaggggaaggggctgggaggtggggtggaccaaacataaaacgaaagacggaagtacaagaaaaacctagtgtaggactctaggtagaccgggccgattccacccatcnccagagaccaaacggccaaagacttcactagttatttcgacaaagtcgaaacagacctggaagagggacggaaggaactaccggggccgttagtagtttagttggtgacggcgagtatggaataggtacgacctactaacgaagttagcgtagggaggtatgacgtttg

SEQ ID NO: 371768 - DNA, 590 bp, Homo sapiens
  misc_feature: GZ8MTXP02JAJIG.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccagggcccgggggggtccctggagactctcctgtgcagtctctggattcacccttagagttattggatgacctgggtccgccaggctccgaggggaaggggctggaggtggggtggccaaacgataaacaaagacggaaagtcaaagaaaaacctatgtaggactctggagacgggccgattcaccatctccagacgacaacgccaagaattcactgtatttgacaaaatgaaacacgcctaggaagagggacggaagggacgaccgggccgtagttaagttagttggtagtcggacggagtagtagaacgttaggtacgaaccgttctaacgaagtagacgtagggtgtatagtagtttg

SEQ ID NO: 371769 - DNA, 588 bp, Homo sapiens
  misc_feature: GZ8MTXP02IYU7X.15.67.G01.1.454.CMB.2.raw
  modified_base (494)..(494): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagactctcctgtgcagtctctggattccacccttagaagttattggatgacctggggtccgccaggctccgaggggaagggcgtggaggtgggtcggaccaaacaataaaaccaaaggacggaagtacaaagaaaaacctgtagtaggactgtgtagacgggccgattccaccatctacagacgaacaacgaccaaagaattcacgttgtaatttgactaaatagaaacacgacctaggagacgggngaacggaccgacggccgtagtattagttgtgcgacgagatgaacgtagtacgacgtatacgaaggtacgacgtagggtagtactggtactttgg

SEQ ID NO: 371770 - DNA, 542 bp, Homo sapiens
  misc_feature: GZ8MTXP02I9T5C.15.67.G01.1.454.CMB.2.raw
  modified_base (415)..(415): a, c, t, g, unknown or other
  modified_base (435)..(435): a, c, t, g, unknown or other
  modified_base (453)..(453): a, c, t, g, unknown or other
  modified_base (490)..(490): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggattcacccttagaagttatggatgacctgggtccgccaggctccaggggaaggggctggagtgggtggccaacataaaacaaagacggaagtacaagaaaacctatgtaggactctgtgacggccgattcaccatctccaganacaacgccaaagattcactntatttgacaaatgaaacngcctgagaggcggagacgacggccgtgtacttattgngcgtacgagatgaatagtagactntacgaagtagcgaggtgtatggatttgg

SEQ ID NO: 371771 - DNA, 580 bp, Homo sapiens
  misc_feature: GZ8MTXP02JV13R.15.67.G01.1.454.CMB.2.raw
  modified_base (346)..(346): a, c, t, g, unknown or other
  modified_base (382)..(382): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggaggtgggtggaccaanaataaaacgaaaggacggaagtacaagaaaaacctntagtggactcgtgtgacggccgattctaccatctcagagacaacgcaaagacttcactgtattagactaaatgaaacagacctggaagaggcggaaggaccgaacggtccgtagtatttagtgtacgcgtacggaagagtacgaagtagtacggacttcgtaactaaggtacgacgtaggggtggtataggacgtttg

SEQ ID NO: 371772 - DNA, 570 bp, Homo sapiens
  misc_feature: GZ8MTXP02GVG8Q.15.67.G01.1.454.CMB.2.raw
  modified_base (472)..(472): a, c, t, g, unknown or other
  modified_base (562)..(562): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgtttggtccgaggcccgggggggtccctggagactctcctgtgcagtctctggattcacccttagaagttattggatgacctgggtccgcaggctccaggggaaggggctggagtggggtggccaaacataaaacaaagaacggaaagtcaaagaaaaaccctatagtaggactctagtgaccgggccgattccaacctatctaccaaggaagacaaacgccaaagaattcaactgtatttagacaaaatnaaacgagacctaggagaggcggaaggaccacggccgtgtacttagtgtgcgcgagatgaatagagactactacaagtagcgaggtgtaancggattcg

SEQ ID NO: 371773 - DNA, 691 bp, Homo sapiens
  misc_feature: GZ8MTXP02J4PUG.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggcttggtccgaggcccgggggggtccctgagactctcctgtgcagtctctggattcaccttagaagttattggatgaccgtggtccgccaggctccgaggggagggctggagtgggtagccaaacataaacgaaacgacggtaagtacaagtaaaaaccctgtgtcggacttcgtaggttacggaccggggtcccgtaaactttccaccctaactccctaccgaaacgaacgaaacccaaaaccggccctaaaaggaactttaccctaacggttagtttatttttaggaaccgttaaaaacgtaacgaacgaacgtaccgtacggacgggacgggacgggacggaccggtaccggtacggttacgttaacgtttagttacggtcggacggacggagtagtagtaagttaacgtaacgtacgtacgtaacgtaaggtacgtacgtacggtaggttacgttacgtagtttcg

SEQ ID NO: 371774 - DNA, 541 bp, Homo sapiens
  misc_feature: GZ8MTXP02H8J80.15.67.G01.1.454.CMB.2.raw
  modified_base (302)..(302): a, c, t, g, unknown or other
  modified_base (517)..(517): a, c, t, g, unknown or other
  modified_base (523)..(523): a, c, t, g, unknown or other
tcagtctacgtagccacgaccggtgctcgatttagagtatacatattgggtttgaggtctcagagaggagccttagccctggactccaaggcctttccacttggttatcagcactgagcacagaggactcaccatggagttggggctgagctgggttttccttgttgttattttagaaggtgtccagtgtgaggtgcacttggtggagtcgtgggggagcttggtccaggccggggggtccctgagactctcctgtgcagtctctgattcacccttagaagttattggatgacctgggtccncaggctccagggaaggggctggagtgggtggccaaacataaaacaaagacggaaagtcaagaaaaactatgtggactctgtgaacggcgattcaccatctcagacgacaacgcaaagaattcactagtatttagacaaaatgaaacagcctagaaggaggcgaagggacacggtaccgtgtaattatgtagcgcgagatgatagagtactactanagtganaaggtggtatggatgttg

SEQ ID NO: 371775 - DNA, 552 bp, Homo sapiens
  misc_feature: GZ8MTXP02HY1I5.15.67.G01.1.454.CMB.2.raw
  modified_base (343)..(343): a, c, t, g, unknown or other
  modified_base (408)..(408): a, c, t, g, unknown or other
  modified_base (451)..(451): a, c, t, g, unknown or other
  modified_base (463)..(463): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggccggggggtcctgagactctcctgtgcagtctctggattcacccttagaagttattggatgacctgggtcccgccaggctccgaggggaaggggctggagtgggtggcccaanataaaacaaagacggaaagtcaagaaaaacctatagtgactcgtgtagacggcgattcaccatcnccagagacaacgcaaagaatcactgtattagactaaatgaaangcctagagaggngacggacacggccgttgaattagtgtgcgagagagtagaagtagtagaacttacaacaagttaagacgtagggtggtatgtaatttcgg

SEQ ID NO: 371776 - DNA, 537 bp, Homo sapiens
  misc_feature: GZ8MTXP02JKHBS.15.67.G01.1.454.CMB.2.raw
  modified_base (414)..(414): a, c, t, g, unknown or other
  modified_base (482)..(482): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctggagtggggtggccaacataaaacgaaagacggaagtacaagaaaaacctatgtgactctgtgacggccgattcaccatctccaganacaacgcaagattcactgtattgacaaatgaacagcctgagaggcgagacgacggcgtgtattattgngcgtcgagtatagagtaagtacgtactcctanaagtagacgtaggtgtatgattg

SEQ ID NO: 371777 - DNA, 554 bp, Homo sapiens
  misc_feature: GZ8MTXP02HM5DF.15.67.G01.1.454.CMB.2.raw
  modified_base (418)..(418): a, c, t, g, unknown or other
  modified_base (455)..(455): a, c, t, g, unknown or other
  modified_base (494)..(494): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggcccggggggggtccctgagactctcctgtgcagtctctggattcacccttagaagttattggatgacctgggtccgccaggctccgaggggaagggctggagtgggtggccaaacataaaacgaaagaacggaagtcaaagaaaaaccctatgtggactctgtagacggccgatcaccatctccaganacaacgccaagaattcactgtattgacaaatgaaacnggcctgagaggacgaggacgtacggcgtgtattagttgngcgacgagataggactagtacgactacgtacaagtagacgtagggtagtatagtagttcg

SEQ ID NO: 371778 - DNA, 545 bp, Homo sapiens
  misc_feature: GZ8MTXP02HL9OG.15.67.G01.1.454.CMB.2.raw
  modified_base (346)..(346): a, c, t, g, unknown or other
  modified_base (382)..(382): a, c, t, g, unknown or other
  modified_base (389)..(389): a, c, t, g, unknown or other
  modified_base (406)..(406): a, c, t, g, unknown or other
  modified_base (411)..(411): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcacccttagaagttattggatgacctgggtccgccaggctccgaggggaagggctggagtgggtggaccaanaataaaacaaagacggaaagtcaaagaaaaacctangtgactngtgacgccatcacatcncaganacaacgaccaagattcactgtatttgacaaatgaacagcctagagaggacgagacacggcgtagtattatgtagcgtacgagatagagtacgtagactacgtaactaaggtacgacgtaggtgtagtgtacttg

SEQ ID NO: 371779 - DNA, 543 bp, Homo sapiens
  misc_feature: GZ8MTXP02IA959.15.67.G01.1.454.CMB.2.raw
  modified_base (408)..(408): a, c, t, g, unknown or other
  modified_base (491)..(491): a, c, t, g, unknown or other
  modified_base (500)..(500): a, c, t, g, unknown or other
tcagtctacgtagccacgaccggtgctcgatttagagtatacatattgggttttgaggtctcagagaggagcccttagcccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaaggggctggaggtgggtgaccaacataaaacaaagaacggaagtcaagaaaaacctatgtagactctgtagacggcgatccaccntctccagagacaacgaccaagaattcactgtatttgactaaatgaaacagcctagagaggacgaggtacgacggcgtgtattntcgtagcgngagatggatagtagactctacgaagtagacaggtgatgacttg

SEQ ID NO: 371780 - DNA, 589 bp, Homo sapiens
  misc_feature: GZ8MTXP02JKLYM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccagccgggggggtcctgagactctcctgtgcagtctctggattcacccttagaagttattggatgacctgggtccgccaggctccgaggggaaggggctgggagtggggtggacccaaacaataaaacgaaaaggaacgggaaagtacgaagaaaaaaccctatagtggaactctggtagaccggccgattccaccatctccagagaccaacgccaagaatcactgtacttgacaaatgaaacagcctgagaggcgaagacgacggccgtgtattagttgagcgacgagagtaggataacggttagaaccgttctaaaccgtaaggttagaccgtagggtaggttagtacggtatttcggg

SEQ ID NO: 371781 - DNA, 582 bp, Homo sapiens
  misc_feature: GZ8MTXP02I1CXM.15.67.G01.1.454.CMB.2.raw
  modified_base (455)..(455): a, c, t, g, unknown or other
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagagttattggatgaccgtgggtcccgccgaggcctccgaggggaaggggcgtgggaggtgggtggaccaaacataaaacgaaagacggaagtacaagaaaaacctagtgtaggactctgtacgacgggccattccaccatctcagagacaaccgaccaaagattcactgttatttnacaaatgaaacagcctaggaggaggacggaggaccgacggccgtagttattagttgngtcgacggagtatggtaaactaggtacgacttactaacgaaggtacgacgtagggtggtagtgtagtttg

SEQ ID NO: 371782 - DNA, 613 bp, Homo sapiens
  misc_feature: GZ8MTXP02JIRLY.15.67.G01.1.454.CMB.2.raw
  modified_base (380)..(380): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggagactctcctgtgcagtctctggattcacccttagaagttatggatgacctgggtccgccaggctccgaggggaaggggctgggagtgggtggccaacataaaacgaaagacggaagtacaagaaaaacctntagtgacttcgtgtacgacgggccattccgaccatctccagacgacaaacgaccaaagaattcactgtatttgactaaatacgaaacagacctaggaggaacgggcggaaggaaccgacgggacccggttaggttaatttagttggtagccggtacgaggtatggtaaacttaaggtacgaacttcgtaacgtaaggtacgacgtaggggtagttacgtacggtaagtttcgg

SEQ ID NO: 371783 - DNA, 545 bp, Homo sapiens
  misc_feature: GZ8MTXP02GXAM9.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctggggtccgccaggctccgaggggaaggggctggagtggggtggccaacataaacaaagacggaagtacaagaaaaacctgtagtaggactcgtgtagacgggccgattcaccatctccagagacaacgccaagattcactgtatttgacaaatgaaacagcctgagaggcgaggacacgggccgtgtacttatgtgcgcgagatgatagtagactcaacgaagtacgacgtagggtgtatggattgg

SEQ ID NO: 371784 - DNA, 709 bp, Homo sapiens
  misc_feature: GZ8MTXP02F5I5R.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggtcgttggtccgagggccggggggtccctggagactctcctgtgcagtctctggattcacccttagaagttattggatgacctgggtcccgccaggctccgaggggaagggcgtggaggtgggtcgaccaacaataaaacgaaaagaaccggaagtacgaaaagaaaaacctagtagtacggaacttcgtaggtacgaccgggccgtaactttaccgaaccctagttacctacccgaagaacgaaccaaaccgacccaaagtaacttaccaacttgttaatttgaactaaaagttacgaaaacgacgtccctaaggaaggacgggacgggaacggaacccgacgggtacccgttaggtttaaactttagttagggttacgacccggacggtaaaggtagttacggaaaagttacggtaacgttaactccttaaaaccgaagttaggaaccggttaggggttaggtacgttacggtaacgttttacggg

SEQ ID NO: 371785 - DNA, 557 bp, Homo sapiens
  misc_feature: GZ8MTXP02H6NES.15.67.G01.1.454.CMB.2.raw
  modified_base (392)..(392): a, c, t, g, unknown or other
  modified_base (416)..(416): a, c, t, g, unknown or other
  modified_base (449)..(449): a, c, t, g, unknown or other
  modified_base (454)..(454): a, c, t, g, unknown or other
  modified_base (456)..(456): a, c, t, g, unknown or other
  modified_base (459)..(459): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttattttagaaggtgtcagtgtgaggtgcacttgggtggagtctgggggaggcttggtccaggccggggggtcctgagactctcctgtgcagtctctggattccaccttagaagttatggatgacctggtccgcaggctccgaggggagggctggaggtgggtggaccaaacaaataaaacgaaaagaacggaaagtcaaaggaaaaaacctagtagtaggaactntggtacgacggccaattcacatcncagagacaaacgcaaagaattcaactgtattanaacananaanagacgagagagagagacgacgacgtagtagtagtgtgcgacgagagtagtagtagtacgtactactacgtaagtagacgtaggtaggtagtagtagtg

SEQ ID NO: 371786 - DNA, 542 bp, Homo sapiens
  misc_feature: GZ8MTXP02JL7SI.15.67.G01.1.454.CMB.2.raw
  modified_base (339)..(339): a, c, t, g, unknown or other
  modified_base (368)..(368): a, c, t, g, unknown or other
  modified_base (399)..(399): a, c, t, g, unknown or other
  modified_base (429)..(429): a, c, t, g, unknown or other
  modified_base (434)..(434): a, c, t, g, unknown or other
  modified_base (439)..(439): a, c, t, g, unknown or other
  modified_base (488)..(488): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccagggcccggggggtccctggagactctcctgtgcagtctctggattcacccttagaagttatggatgacctggtccgcaggctcgaggggaggctggagtgggtgccaanataaacaaaggacgaatcaagaaaacctngtagactctgtgaccggcgattcgaccatcncagacacacgaccaagatcatgtattcganaaatnaaacngcctagagaggacgaggaccaggcgtagtacttagttgtgcgacgtagngtagagtacgtagaccgtacaactaaggtacgcgtaggtgtagtacgtagtttg

SEQ ID NO: 371787 - DNA, 604 bp, Homo sapiens
  misc_feature: GZ8MTXP02JIJXS.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagaagttattggatgactgggtccgccaggctccgaggggaaggggctgggaggtggggtggaccaaacaataaaacaaaaggacggaaagtacaaagaaaaaaccctataggtaggactcgtagtaggacgggccgaagttccaccctatcctaccaagacgaacaaacgccaaagacttacactgtatttgacaaatgaaacagacctggaagaggacggaaggaccgacgggccgtagtatttagttcgtgcggacgagagtagaagtaggtacgtacctacgaagtaagtacgacgtagggtaggtaacgtgacgtttgg

SEQ ID NO: 371788 - DNA, 550 bp, Homo sapiens
  misc_feature: GZ8MTXP02F0QO9.15.67.G01.1.454.CMB.2.raw
  modified_base (408)..(408): a, c, t, g, unknown or other
  modified_base (444)..(444): a, c, t, g, unknown or other
  modified_base (506)..(506): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcaccttagaagttattggatgacctgggtccgcaggctccgaggggagggctggagtggggtggccaaacataaacaaagacggaagtacaagaaaaacctatgtaggactctgtagacggccattcaccatcnccagacgacaaacgcaaagaacttcactgtattganaaaatgaaactagccctagagaggacgaggaccacgggcgtagtattagtcgtgcgacgagntagatacgtacgactactagaagtcgagtaggtgtagtcgattg

SEQ ID NO: 371789 - DNA, 572 bp, Homo sapiens
  misc_feature: GZ8MTXP02J0RGP.15.67.G01.1.454.CMB.2.raw
  modified_base (515)..(515): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattccacccttagaagttattggatgaccgtgggtcccgccgaggctccgaggggaaggggcgtggaggtggggtggccaaacataaaacaaaggaacggaagtacaagaaaaacctatagtggactctgtgaccggccgattccaccatctaccagacacaacgaccaaagaattcactgtaatttgacaaatagaaacagacctagagaggacggagacgacggcgtgttattagttgtgcggngagtatggaatagtagacctactaacgaagtagtacgagggtgtacgtaggatttgg

SEQ ID NO: 371790 - DNA, 602 bp, Homo sapiens
  misc_feature: GZ8MTXP02GI7ZF.15.67.G01.1.454.CMB.2.raw
  modified_base (318)..(318): a, c, t, g, unknown or other
  modified_base (353)..(353): a, c, t, g, unknown or other
  modified_base (389)..(389): a, c, t, g, unknown or other
  modified_base (553)..(553): a, c, t, g, unknown or other
  modified_base (590)..(590): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggtcgttgggtccgacggggtcccggggggtccctggagaccttctccgtgtgctagtctctggattcacccttagagttatggatgaccgtgggtccncaggctcgaggggagggctggagtggtgaccaaanataaaacgaaagacggaagtacaaaagaaaaacctntgtaggaactcgtaggtagaccggggcctattaccgaaccatcctaccaagaacgaacgaaaccgaccaaagaacttacactagttatttacgataaaatgaaactacgacgtaggaggagggacggaaggaccgacggccgttagtattagtggtgcgacganagtagattaggactactccaagaagtagacgttaggngtatggtacttg

SEQ ID NO: 371791 - DNA, 593 bp, Homo sapiens
  misc_feature: GZ8MTXP02G5HMM.15.67.G01.1.454.CMB.2.raw
  modified_base (426)..(426): a, c, t, g, unknown or other
  modified_base (429)..(429): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggcccgggggggtccctgagactctcctgtgcagtctctggattcacccttagaagttattggatgaccgtgggtcccgccaggctccgaggggaggggcgtggaggtgggtcggaccaacaataaaacgaaaggaacggaaagtacaaagtaaaaaccctagtagtggactcgtaggtgaccgggcgatccaccntcnccagagacaacgcaagatcacttgtatttagactaaatcgaaacacgaccgtaggaaggacgggacggaacggaccgaaccgggtccgtagttattagtttggaggtccggacgagagtacgatagtacgactgtaacaagtacgacgaggtgacgtgtagttg

SEQ ID NO: 371792 - DNA, 555 bp, Homo sapiens
  misc_feature: GZ8MTXP02H6N9O.15.67.G01.1.454.CMB.2.raw
  modified_base (342)..(342): a, c, t, g, unknown or other
  modified_base (414)..(414): a, c, t, g, unknown or other
  modified_base (508)..(508): a, c, t, g, unknown or other
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggagggctgggagtgggtggccaanataaaacaaagacggaaagtcaagaaaacctatagtggactctggtgacggccgtaattccaccatcaccanacgacaacgaccaagaatcactgtattttagactaaatagaacaagcctaggaagagggcgaaggacacggcgtagtattagtgtgcgcgaagntgaatagtaacgactntaacaagtacgagtaggtagtagtgtattcg

SEQ ID NO: 371793 - DNA, 540 bp, Homo sapiens
  misc_feature: GZ8MTXP02GQDPB.15.67.G01.1.454.CMB.2.raw
  modified_base (381)..(381): a, c, t, g, unknown or other
  modified_base (456)..(456): a, c, t, g, unknown or other
  modified_base (483)..(483): a, c, t, g, unknown or other
  modified_base (486)..(486): a, c, t, g, unknown or other
  modified_base (488)..(488): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccggggggggtccctgagactctcctgtgcagtctctggattcacccttagaagttattggatgacctgggtccgccaggctccgaggggaaggggctggagtggggtggccaaacataaaacaaaggacggaagtcaagaaaaacctntgtggactctgtgaccggccgattcacatctccagagacaacgccaaagaattcactgtattgacaaatgaaacngcctgagaggcgagacaggctgtattntgngngtcgagatcgataggtagactctaacaagtaacggcgtaggtgtagtgtatg

SEQ ID NO: 371794 - DNA, 627 bp, Homo sapiens
  misc_feature: GZ8MTXP02IIQS1.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggagcttggccaggcccggggggtccctgagactctcctgtgcagtctctggattcacccttagaagttatggatgacctgggtccgccaggctccgaggggaaggggctggagtgggtggccaaacaataaaacaaagaacggaagtacaagaaaaacctagtgtaggacttcgtaggtacgacgggccgattccgacctatctaccaagaacgacaaaccgaccaaagtaacttcacttagttatttagacaaatgaaacacgaccgtaggaagacgggacggaacggacgaccgggcgttagttaagtttagttaggtcgacgtacggaagtataggaattaaggttaacgtaaccttaccgtaaagaaggttacgacgttaggggttagtaagtttacggtaagtttgg

SEQ ID NO: 371795 - DNA, 608 bp, Homo sapiens
  misc_feature: GZ8MTXP02JZG6M.15.67.G01.1.454.CMB.2.raw
  modified_base (345)..(345): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgagggcccgggggggtccctggagactctcctgtgcagtctctggattcacccttagaagttattggatgacctggtccgccaggctccaggggagggctggagtgggtgccaanataaaacaaagacggaagtcaagaaaaacctatagtaggactctgtgacggcgattccacatctacagacgaacaacgccaaagattcactagtatttgactaaagtcgaaactagaccgtaggagaggacggaggacgaccgggaccgttagttaacttagtttaggtcggcgtacggaaagtataggtaaagtaagtaagaccttaaccgttaaacgaaggttaaccgacggtaggggttaggtacgttaggtaagtttgg

SEQ ID NO: 371796 - DNA, 645 bp, Homo sapiens
  misc_feature: GZ8MTXP02JISRR.15.67.G01.1.454.CMB.2.raw
  modified_base (602)..(602): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgtttattttagaaggtgtccagtgtgaggtgcacgttggtggagtcgtgggggagtcgttggtccgaggccggggggtccctgagacctctcctgtgcagtctctggtattcacccttagaagttattgatgaccgtggtccgccaggcctccgaggggaacggggctgggaggtgggtcggaccaaacaactaaaacgaaagacggaagtacaaagaaaaaccctatggtagactcgtggtacgacgggcctacttccgaccactcctaccagaacgaaccgaaaccgaccgaaaagtaacttactaacttgttaaatttacgaacctaaaagttagaaaaccacgtaccgtagaacggaggacggaaggaccgacggccgttagttagttagtggtcgcggtacggagtagtacgaagttagtagtaacccgtntaacgaaggtaacgcggtaggttaggtagttaaggtctttagg

SEQ ID NO: 371797 - DNA, 544 bp, Homo sapiens
  misc_feature: GZ8MTXP02IGL93.15.67.G01.1.454.CMB.2.raw
  modified_base (453)..(453): a, c, t, g, unknown or other
  modified_base (465)..(465): a, c, t, g, unknown or other
  modified_base (490)..(490): a, c, t, g, unknown or other
  modified_base (498)..(498): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttgggtccgaggcccgggggggtccctggagactctcctgtgcagtctctggattcacccttagagttatggatgacctgggtccgccaggctccgaggggaaggggctggagtgggtggccaaacataaaacaaaggaacggaagtacaagaaaaacctatgtagactctgtgacgggccgtatccaccatctcagacgacacgccaagaatcactgtatttgacaaatnaacagcctgagnggcgagcgacggcgtgtattagtgngcgcgagntgagtagtacgacttctagcgtaagcgtagggtaggtagtgatttg

SEQ ID NO: 371798 - DNA, 528 bp, Homo sapiens
  misc_feature: GZ8MTXP02IMVLI.15.67.G01.1.454.CMB.2.raw
  modified_base (427)..(427): a, c, t, g, unknown or other
  modified_base (457)..(457): a, c, t, g, unknown or other
  modified_base (483)..(483): a, c, t, g, unknown or other
  modified_base (486)..(486): a, c, t, g, unknown or other
  modified_base (500)..(500): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggtttttccttgttgttattttagaaggtgtccagtgtgaggtgcacttggtggagtcgtgggggaggctttgggtccaggcccgggggggtccctgagactctcctgtgcagtctctggattcacccttagagttattggatgacctgggtccgccaggctccaggggagggctggagtgggtgccaacataaacaaagacgaagtacagaaaacctatgtgactctgtgacggccgattccacatctcagagacaacgccaaagattcactntatttgacaaatgaaacagcctggagaggnggagacacggcgtgtattatgtgcgngantaggatagagactntacaagtagcgagggtgtatggatttcg

SEQ ID NO: 371799 - DNA, 656 bp, Homo sapiens
  misc_feature: GZ8MTXP02JO3WN.15.67.G01.1.454.CMB.2.raw
  modified_base (260)..(260): a, c, t, g, unknown or other
  modified_base (292)..(292): a, c, t, g, unknown or other
  modified_base (438)..(438): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttccgtgtagtatttagaagtgtccagtgtgaggtgcacttggtggagtcgtgggggagcttggtccaggccggggggtcctgagactctcctgtgcagtctcnggattcaccctagagttatggatgactggccncagctcgagggagggcgtggaggtggtggcaacataaacaaagacggaagtacaaagaaaaacctgtagtaggacctgtaggtacggaaccggccgtaattccaaccgtaactcctacccagacaaccgaaaccgaacccgtaaanaaactttcaacgttagttaacttttagacaaagttaagtaacgacgtaccgtacggaaggaggacgggaacggaccgaaccgggtacccggttacggttaagtttaacgtttacgttacgggtacggtacggtagtagtacggtaaagttaacggtaacgtaacgtaacgtaacgtaaggtaacggtacggtacggtaggtacggtacgtacgttacg

SEQ ID NO: 371800 - DNA, 670 bp, Homo sapiens
  misc_feature: GZ8MTXP02JNPN0.15.67.G01.1.454.CMB.2.raw
  modified_base (517)..(517): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcattggtggagtcgtgggggaggcttgggtccgagggcccgggggggtccctggacgacctcgtcctgtgctagtctctggattccacccttagaagttatggatgacctgggtccgcgaggctaccgaggggaaggggtctgggaggtggggtcggaccaaacgaataaaacaaaggaacggaagtacaaagaaaaacctgtagtaggactctggttacgaccgggccaagttccaacctataccctaccaagaacgaccgaaaccgacccaaaaggaactttaccgacttgttaactttagacctaaaagtcgaaaacncggaccgtaggagacgggacgaacgggaaccgtaccggaccgtagtagtttagttggtcgtacgcggaatagtacggagttaacggtaacgtaccgttacctaacgtaagtaacggtacgtacggggttaggtacgttacggtacgttttagg

SEQ ID NO: 371801 - DNA, 568 bp, Homo sapiens
  misc_feature: GZ8MTXP02JOXNX.15.67.G01.1.454.CMB.2.raw
  modified_base (396)..(396): a, c, t, g, unknown or other
  modified_base (442)..(442): a, c, t, g, unknown or other
  modified_base (457)..(457): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggggtccctggagactctcctgtgcagtctcgtggattcacccttagagttatggatgaccgtggtccgcaggcctccgaggggagggctggagtgggtggaccaaacaataaacgaaaggaacggaagtacaaagaaaaaccctatagtggactcgngtagacggccgattccaccatctacagacacaacaccaagatcatntattgataatagaanacgactgagaggacgaaggacgacggccggtagtacttaagttgtagtcgacgagtagagaagtagacgtacgtacctaagaagtagacgagggttagtagtaggtattag

SEQ ID NO: 371802 - DNA, 563 bp, Homo sapiens
  misc_feature: GZ8MTXP02JOU4B.15.67.G01.1.454.CMB.2.raw
  modified_base (225)..(225): a, c, t, g, unknown or other
  modified_base (279)..(279): a, c, t, g, unknown or other
  modified_base (297)..(297): a, c, t, g, unknown or other
  modified_base (553)..(553): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccggnaagtcaggacattagactgacttaggttgtatcagcaagaaacgtccgggaaancccctaagctcctgatcngtgctgctatcctaactttaacgaaaggtcgggtaccccctagtaccgtaaggttccgaggcgctaggtgggatcgtgggactacgagtactttcactctacaccatcagcacgcctgcagacctagaagtactttcgactaactttattacgagttacctaagaagtacttaaccaacgttacccgtacggacgttccggacggtaacggggaccaagggtaacggaaactacgaaaacgtcgtaaggtcggacncgaccactag

SEQ ID NO: 371803 - DNA, 575 bp, Homo sapiens
  misc_feature: GZ8MTXP02IOZJ0.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtctgggggaggcttgggtccaggccgggggggtccctgagactctcctgtgcagtctctggattcacccttagaagttattggatgacctgggtccgccaggctccgaggggaaggggcgtggaggtggggtggccaaaacataaaacaagaacggaagtacaagaaaaaaccctagtgtggactcgtgtgacggccgattaccacatctaccagacgacaacgaccaaagattcactgtatttgacaaatgaaacagcctcgagagggcggaaggaccgacggccggtgtattagttgtagcgtcgagatgaagtagtacgactacctaacgtaaggtaagcgtagggtggtaagtgtaagtcgg

SEQ ID NO: 371804 - DNA, 575 bp, Homo sapiens
  misc_feature: GZ8MTXP02HREAJ.15.67.G01.1.454.CMB.2.raw
  modified_base (303)..(303): a, c, t, g, unknown or other
  modified_base (343)..(343): a, c, t, g, unknown or other
  modified_base (420)..(420): a, c, t, g, unknown or other
  modified_base (455)..(455): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtcctgagactctcctgtgcagtctctggattcacccttagagttatggatgacctgggtccnccaggctccgaggggaaggggctgggagtgggtggcaaanataaacaaagacggaagtacaaagaaaaacctatgtaggacctgtagtagacggaccgattacacctatcctcaganacaacgacaagatcactgttattgacaaatgaaanagcctagagaggacggaggaacaccggtacgtagttattagttgtagccgacgaggatgaaattacggagtaccctattaaccgaagttacgacggtaggttaggtaatggtaatttcgg

SEQ ID NO: 371805 - DNA, 578 bp, Homo sapiens
  misc_feature: GZ8MTXP02F4W7O.15.67.G01.1.454.CMB.2.raw
  modified_base (393)..(393): a, c, t, g, unknown or other
  modified_base (553)..(553): a, c, t, g, unknown or other
  modified_base (572)..(572): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcaccttagaagttattggatgacctgggtccgccaggctccgaggggaaggggctgggagtggggtggccaaacataaaacaaaagacggaaagtacaaagaaaaacctatagtggactntgtagacggccgattcaccatctaccagaacgacaaacgcccaaagaattcaactgtaatttgacaaaatgaaacagaccctaggagagggacggaaggaaccgacgggaccgttagtaatttagttgtgcgacggagatggaatagtacgaactcgtanaagtagcgtaggtgtaacngatttg

SEQ ID NO: 371806 - DNA, 529 bp, Homo sapiens
  misc_feature: GZ8MTXP02IRTWX.15.67.G01.1.454.CMB.2.raw
  modified_base (344)..(344): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctggagtgggtggccaanataaacaaagacggaagtacaagaaaaacctatgtaggactctgtagacggccgattcaccatctccagagacaacgcaagatcactgtattgacaatgaacagcctgagaggacgaggacacggcgtgtattatgtgcgtcgagatgatagtagactacacaagtgacgtaggtgtatgtattg

SEQ ID NO: 371807 - DNA, 567 bp, Homo sapiens
  misc_feature: GZ8MTXP02HCZOP.15.67.G01.1.454.CMB.2.raw
  modified_base (384)..(384): a, c, t, g, unknown or other
  modified_base (409)..(409): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggattcacccttagaagttattggatgacctgggtccgccaggctccgaggggaaggggctggaggtgggtggaccaacaataaaacaaagacggaagtcaaagaaaaacctangtagactctgtgacggcattcaccntctcagagacaacgacaagaatcactgtatttgacaaatgaacagcctagagacggcgaggacacgggcgttagtagttattaggtgcgtcggagtattaggattaaggtacgtactacgtaactaagtaacgcgtaggggtagtagtgtaactttgg

SEQ ID NO: 371808 - DNA, 691 bp, Homo sapiens
  misc_feature: GZ8MTXP02HM0BE.15.67.G01.1.454.CMB.2.raw
  modified_base (269)..(269): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtcctgagactctcctgtgcagtctctggntcaccttagaagttatggatgacctgggtccgcaggctccgaggggagggctgggagtgggtcggaccaaacaaataaaacgaaaggaacgggaaagtacaaaggaaaaaaccttagtaggtaggtaacctcgttaggtacggaaccggggcccgtaattaccaaacccgtattcctacccgaagaacgaaccaaaacgcccaaaagtaacttccaaacgtttgttaaacttttacggaactaaaaagttacgaaaaccgtaacggtacccgttaggaaacggaggggaccgggaaaggggaacccgtacggggtaccgtagtttaagttagttgggtcgacgggtacgaaggatacggtaagttaaggtaacgtacttactaacgaagttacggacgtagggtagttagtagtacgtttgg

SEQ ID NO: 371809 - DNA, 646 bp, Homo sapiens
  misc_feature: GZ8MTXP02I40DS.15.67.G01.1.454.CMB.2.raw
  modified_base (401)..(401): a, c, t, g, unknown or other
  modified_base (428)..(428): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgagggcccggggggtccctgagactctcctgtgcagtctctggattccacccttagaagttattggatgacctgggtcccgccaggctccgaggggaagggctgggaggtgggtggaccaaacgataaaacgaaaagaccggaaagtacgaaagaaaaactagtgtaggactntagtgaccggccgtaattaccgacctntaccctccaagacgaaccaaccgaccaaagtaacttcaacttagttatttagaacctaaatagaaaacgacgtaccgttagggagaacgggaccgggaaaggacccggaaccgggtccgttaggttaactttagttggtagccggacgaagtagtagtaaacgtaggtacgtaacttcgtaacgaaggttaacgcgtagggtagtaatcggtaatttg

SEQ ID NO: 371810 - DNA, 625 bp, Homo sapiens
  misc_feature: GZ8MTXP02GA9EM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctggagactctcctgtgcagtctctggattcacccttagaagttatggatgacctgggtccgccaggctccgaggggaaggggctggagtgggtggccaacataaacaaagaacggaagtacgaagaaaaacctatgtaggaactcgtaggttggaccgggccgagttccaaccctatcctacccgaagacgaaccaaacggacccaaaagtaacttaccaacttagtaattttcggaacctaaaagtgaaaccaggaccctaggaagacgggacggaacggaccgacgggaccgttagttattagttggtgcggtacgaagagttcgaaattagtaacgactcctaagaagttagcgtagggtggtagtgtaagtttcgg

SEQ ID NO: 371811 - DNA, 714 bp, Homo sapiens
  misc_feature: GZ8MTXP02GX3B5.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggtcgttgggtccgagggcccgggggggtccctggacgactctcctgtgcagtctcgtggattccacccttagaagttattggatcgacgtggtccgccaggctcgaggggagggctggaggtgggtggaccaaacaagtaaaacgaaaaggacggaaagtacaaagaaaaaccctatgtaggacttcgtggtacgaccggggcctaattccaccctatccctaccgagaaacgaaccaaacccgaccaaaagtaacttaccgaacttaggttaacttttaggaaacctaaaagttagaaaaccgtaacggtacccgtaggggaacgggaacggggacgggaaaccggggaaccgtaaccgggggtacccggttaagttaacgtttaaggttcggtcggaccggttacggaggtagtacggtaaacgttaggtaactaaccgttacgtaaccgaaggttacgacggtagggttaggtaattacgggtacttttacgg

SEQ ID NO: 371812 - DNA, 606 bp, Homo sapiens
  misc_feature: GZ8MTXP02HCIGW.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagactctcctgtgcagtctctggattcacccttagaagttattggatgaccgtgggtccgccaggcctccgaggggaaggggctgggaggtggggtgaccaaacgaataaaacgaaaggaacggaagtacaaagaaaaacctagtgtaggactcgtgtacgacggccgaattccgaaccatcctaccaagacgaacaaaccggacccaaagaactttacacttagttatttacgacaaaatcgaaaacgacaccgtgaaggaggacgggagaccgacgggtacgtagtatttagtgtgccgagagagtgacgtagtacgactacgtaacaaggtacgacgtaggtgtaagtgtatttgg

SEQ ID NO: 371813 - DNA, 595 bp, Homo sapiens
  misc_feature: GZ8MTXP02HVJJU.15.67.G01.1.454.CMB.2.raw
  modified_base (339)..(339): a, c, t, g, unknown or other
  modified_base (561)..(561): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcaccttagaagttatggatgacctgggtccgcaggctcgaggggagggctggagtgggtgccaaanataaacaaagacggaagtacaagaaaaacctgtagtagactcgtgtagaccggggccattcaccctagtctaccagagaacaacgaccaaagactcactgttatttgactaaagtacgaaacagaccctaggaagacggggacggagggaaccgtaccgggccgttggtaactttagtcgggtgccggacgagtatacggaattagtaacgactttaccganaaaggttcgacgtagggtagttaatgtacgtttg

SEQ ID NO: 371814 - DNA, 537 bp, Homo sapiens
  misc_feature: GZ8MTXP02GVL0T.15.67.G01.1.454.CMB.2.raw
  modified_base (527)..(527): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttatggatgacctgggtccgccaggctccaggggaaggggctgggagtggggtggccaaacataaaacaaagacggaagtacaagaaaaaacctatgtggactctgtagacggccgattcaccatctccagagacaacgccaaagaattcactgtatttgacaaatgaaacagcctgagaggcgagacgacggccgtgtatagtgtgcgcgagatgatagtacgactctacaagtagacgtaggngtatgagttg

SEQ ID NO: 371815 - DNA, 558 bp, Homo sapiens
  misc_feature: GZ8MTXP02FW0DO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaagggctgggagtgggtggccaaacataaaacaaagacggaagtacaagaaaaacctatgtaggactctgtagacggccgattcaccatctaccagagacaacgaccaaagaattcaactgttaatttcgacaaaatgaaacagcctaggagagggacgaggacgacgggccgtagtattagttgtgcgtagagatgaatagtacgactctaacgaagtagcgtagggtgtatggattg

SEQ ID NO: 371816 - DNA, 558 bp, Homo sapiens
  misc_feature: GZ8MTXP02GM9GV.15.67.G01.1.454.CMB.2.raw
  modified_base (462)..(462): a, c, t, g, unknown or other
  modified_base (467)..(467): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccgaggtcggggggtccctgagactctcctgtgcagtctctggattccacccttagaagttattggatgaccgtgggtcccgccaggctccgagggagggctggaggtgggtggaccaaacaataaaacgaaaagacggaaagtacaaagaaaaacctagtagtagactcgtgtagaccggccgattccaccatcctacagacacaacgccaaagtatcactgtattgacaaatnaaacngactgagaggacgagacgacggctagttatatgtgcgtgagatagagtaagtacactacaacgaagtagacgtagggtgtacgtgtagttg

SEQ ID NO: 371817 - DNA, 533 bp, Homo sapiens
  misc_feature: GZ8MTXP02H77CC.15.67.G01.1.454.CMB.2.raw
  modified_base (390)..(390): a, c, t, g, unknown or other
  modified_base (451)..(451): a, c, t, g, unknown or other
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctcccgaggggaaggggctgggagtgggtggccaaacataaaacaaagacggaaagtacaagaaaaacctatgtggactcngtgacggcgattcaccatctcagagacacgccaagaatcactgtatttgacaaatgaaacngcctagagagggcgagacacggcgtagtattagtgtagcgcgagatgatacgtagactcanaagtagacaggtgactgattg

SEQ ID NO: 371818 - DNA, 573 bp, Homo sapiens
  misc_feature: GZ8MTXP02GBKO4.15.67.G01.1.454.CMB.2.raw
  modified_base (548)..(548): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggagtcgtgggggaggcgttggtccgagggccgggggggtccctggagactctcctgtgcagtctctggattcacccttagaagttattggatgacctggtccgccaggctccgaggggagggctgggagtgggtggccaaacataaaacaaagacgaaagtacaaagaaaaacctagtgtaggacttcgtgtagacgggccgattccaacccatactccaagaagaccaacgaccaaagaacttcaactgttatttagactaaaatgaaacacgcctaggaggagacgggagaacaccgggctgtattagtgtgacgcggagagtgaagtagtagactcgtaanaagtagcgaggtagtagtggattgg

SEQ ID NO: 371819 - DNA, 607 bp, Homo sapiens
  misc_feature: GZ8MTXP02GV2A9.15.67.G01.1.454.CMB.2.raw
  modified_base (340)..(340): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctggagactctcctgtgcagtctctggattcaccctagaagttatggatgaccgtggtccgcaggctcgaggggaagggctggagtgggtggaccaanaaataaaacaaaggaacggaagtacgaaagaaaaaaccctagtagtacgactcgtagtacgaacgggccgtattccaacctatcctaccaagaacgaaccaaacgacccaaagtaacttaccaattagttaatttacgaactaaaatacgaaacacgaccgtaggaaggacgggacggaacggaaccgacgggtccgtagtaatttagtgtgcgtacgagatcgaatagtacgtactacagtaagtagagtaggtagtatgtacttg

SEQ ID NO: 371820 - DNA, 545 bp, Homo sapiens
  misc_feature: GZ8MTXP02JTGS0.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagttattggatgacctgggtccgccaggctccaggggaaggggctggagtggggtggccaacataaaacaaagaccggaaagtacaagaaaaacctatgtaggactctgtgacgggccgattcaccatctaccagagacaaacgccaaagaacttcactgtatttgacaaatgaaacagcctagagaggcgaggacacggccgtagtacttatgtgcgcgagatgatagtagactctacaagtagcaggtggtatgattgg

SEQ ID NO: 371821 - DNA, 632 bp, Homo sapiens
  misc_feature: GZ8MTXP02GG4LD.15.67.G01.1.454.CMB.2.raw
  modified_base (577)..(577): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctcgtggattcacccttagaagttattggatgaccgtcgggtccgccaggcctccgaggggaaggggctggggaggtggggtcggacccaaaacgaataaaaacgaaaaggaaccggaaagtaccgaaaagaaaaaaccctagtaggtaggacttcgtgttaggaccgggtccgacttaccacccatcctaccgaagaacgacaaaccgcaaaaggaattccaactgttaatttacgacaaaatgaaaccagaccctaggaggacggacgggaaggacccgacgggccgttagtagttagttgtgtaccgnggagatagaataggacgtactactagaagtagcgagggtagtatacgtatttagg

SEQ ID NO: 371822 - DNA, 568 bp, Homo sapiens
  misc_feature: GZ8MTXP02H0NF2.15.67.G01.1.454.CMB.2.raw
  modified_base (304)..(304): a, c, t, g, unknown or other
  modified_base (341)..(341): a, c, t, g, unknown or other
  modified_base (544)..(544): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccnccaggctccaggggaggggctggagtgggtggccaanataaaacaaagacggaagtcaagaaaaacctatgtgactctagtgacggccgaattccgaccatcctaccagagacaacgcgaacgaatactactacgtattagtacaataagaacaagacgtacgagacggacggacggaacgacgacggtcgtagttaagttgtgcgcgagagtagtagtacgtagtactacgtactaagngacgtcggtaggtagtagtgtacg

SEQ ID NO: 371823 - DNA, 739 bp, Homo sapiens
  misc_feature: GZ8MTXP02IWGKG.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtggaggtgcacttggtggagtcgtgggggaggtcgttggtccgagggcccgggggggtccctggacgactcgtcgtgtgcagtctcgtggattccacccttagaagttattggatgaccgtgggtccgccaggctccgaggggaagggctgggaggtgggtcggaccaaacgaataaaacgaaaggaacggaagtacaaagaaaaaccctagtaggtaggacttcgtggtacggaaccgggccgtattaccaaccctatcctaccaaagaacgaaccgaaaccgacccaaaagaacttaccaacgttaggttaatttacggaactaaaagttacgaaaaccgacggtacccttaagggaaggacgggacgggaaacgggaacccgaccgggggtacccggttaggttaaacgtttaagttgggtaggacccggttacggaaggtaagttacggtaaaagttaaggtaacggtaaaccttaccgtaaaaccgtaaggttaaacggaccgtaaacgggggttaggttaaacgttagggtaaacgttttcggg

SEQ ID NO: 371824 - DNA, 668 bp, Homo sapiens
  misc_feature: GZ8MTXP02GZ2E7.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattccacccttagaagttattggatgaccgtgggtcccgccaggctccgaggggaaggggctgggaggtgggtggacccaaacaaataaaacgaaaaggaaccggaaagtacaaagaaaaaacctagtaggtaggaactcgtaggtaggaaccgggcccgtaaatttccaaccctatcctaccaaaggaacgaaccaaaaccgaccctaaaagaaacttactaacgttagttaaatttacgaacaaaagttacgaaaaccgacgacccgttaggaaggacgggacggaacggaaccgtacgggacccgttaggttaatttagttggtggaccgacgaggattaggaattacggtaagacttcctaaagaagtacgacgagggtggtatggtaactttg

SEQ ID NO: 371825 - DNA, 654 bp, Homo sapiens
  misc_feature: GZ8MTXP02H9A71.15.67.G01.1.454.CMB.2.raw
  modified_base (305)..(305): a, c, t, g, unknown or other
  modified_base (325)..(325): a, c, t, g, unknown or other
  modified_base (341)..(341): a, c, t, g, unknown or other
  modified_base (637)..(637): a, c, t, g, unknown or other
  modified_base (652)..(652): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtcctgagactctcctgtgcagtctctggattccaccttagaagttatggatgacctgggtccnccaggctccgaggggaggcnggagtgggtgccaaanataaaacaaagacgaagtacaagaaaaacctgtagtaggactctggtacgaaccgggccgtaattccgaaaccctattcccgaaccaacgaaacggaaacccaaacccggacccaaaaggtaaaacttaccctaacgtttaggtttaatttttaccgaaataaaacgtagaaaaccgacgttacccgaggaaggaggggaccggaaagggacgtaaccggggcccgtttagttagtttaagttgtcggaccgtagaagtgtacgagtaacgtagaccttcgaaacgtaagtacggngtaggtgtagtagtntg

SEQ ID NO: 371826 - DNA, 769 bp, Homo sapiens
  misc_feature: GZ8MTXP02G94DT.15.67.G01.1.454.CMB.2.raw
  modified_base (304)..(304): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccnccaggctccgaggggaaggggctgggaggtggggtggacccaaacaataaaacgaaagaaccggaagtacaaagaaaaacctatgtaggactcgtggtacgaccgggccgtaattccgacctattcctacccaaggaaacgaaccaaacccggacccaaaaggtaactttacccaacttacggtttaaattttacggaactaaaaattcgaaaaaccgtacgcccgttagggaacggaacggggaccgggaaacgggaaccgaaacccgggggtcccgttaggtttaaacgttttaacggttttaggggtacggcccggtacgggtaaaaggtaacgttacggggtaaaagtttaaccgggttaaacgggtaaaaccctttccggtttaaaaccgaaagggtttaacgggaccggtttaaaagggggttagggttaaccgtttacgggtaaaacgtttttcgggg

SEQ ID NO: 371827 - DNA, 562 bp, Homo sapiens
  misc_feature: GZ8MTXP02JJQYU.15.67.G01.1.454.CMB.2.raw
  modified_base (304)..(304): a, c, t, g, unknown or other
  modified_base (543)..(543): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtgggggaggcttggtccaggcccgggggggtccctggagactctcctgtgcagtctctggattcaccctagaagttatgatgacctggtccnccaggctccgaggggaagggctggagtgggtggccaaacataaaacaaagacggaagtacaagaaaaacctagtagtaggactctagtagacggccgattccgaccatcctaccagacgacaacgacaagaatcactgtatttgacaaatgaaacagacctagaaggaggacggaaggaccgacggaccgtagtattagtgtagcgagtagatagagtacgtagactactaacaagtancgtaggtgtactgagtttg

SEQ ID NO: 371828 - DNA, 585 bp, Homo sapiens
  misc_feature: GZ8MTXP02G4GIB.15.67.G01.1.454.CMB.2.raw
  modified_base (307)..(307): a, c, t, g, unknown or other
  modified_base (349)..(349): a, c, t, g, unknown or other
  modified_base (387)..(387): a, c, t, g, unknown or other
  modified_base (553)..(553): a, c, t, g, unknown or other
  modified_base (560)..(560): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggagactcgtcctgtgcagtctctggattcacccttagaagttatggatgacctgggtccnccaggctccgaggggaagggctgggaggtgggtggaccaaanataaaacgaaagaacgggaagtacaaagaaaaaacctntagtaggactcgtggtacgacgccgattccaccatctaccagagacaaacgaccaaagaattcccatgtactttagactaaaagtagaaacagaccgtagaggacggacggaaggaccgtacggccgttagtacttatgtgcgcgagatgaatacgtagactacanaaggtanacggtaggtaggtactagtatttgg

SEQ ID NO: 371829 - DNA, 539 bp, Homo sapiens
  misc_feature: GZ8MTXP02F1FRQ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgacctggtccgccaggctccaggggaaggggctggagtggggtggccaaacataaaacaaagacggaagtacaagaaaaacctatgtaggactctgtgacggcattcaccatctccagagacaacgccaaagaattcactgtatttgcaaatgaaacagacctagacgaggacgaggacgacggccgtagtattagttagtgcgacgagatgagtagtagactctacaagtagcaggtgtatgattg

SEQ ID NO: 371830 - DNA, 549 bp, Homo sapiens
  misc_feature: GZ8MTXP02IF7DW.15.67.G01.1.454.CMB.2.raw
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttgggtggagtcgtgggggaggcttggtccagggcccgggggggtccctgagactctcctgtgcagtctctggattcacccttagaagttattggatgaccgtgggtccgccaggctccgaggggaagggctggaggtggggtcggccaaacataaaacgaaagaacggaagtcaagaaaacctatgtggactctgtcgacgggccgattccaccatctccagagacaacgccaaagaattcactgttatttgacaaatgaaacagcctgagaggcgaggacacggcgttgtattagtgtagcgcgganatgatagtacgactcacaagtagacgtaggtggtatcgattg

SEQ ID NO: 371831 - DNA, 590 bp, Homo sapiens
  misc_feature: GZ8MTXP02I9P9A.15.67.G01.1.454.CMB.2.raw
  modified_base (527)..(527): a, c, t, g, unknown or other
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggccgggggggtccctggagactctcctgtgcagtctctggattcacccttagaagttattggatgacctgggtccgccaggctccgaggggaaggggctgggagtgggtggaccaaacataaaacaaaggacggaagtacaagaaaaaccctagtgtaggactcgtgagaccgggccattccacatctcagacgacaaaccgcccaaagtacttacacttacgtatttgactaaaagtcgaaacgaccgtcgtagaggacgacgggacgacggaccggtcgtattagttagtgngcgagngtagagtattacggactactaccgtagtaagacgagtaggtagagtacgtgtttacg

SEQ ID NO: 371832 - DNA, 580 bp, Homo sapiens
  misc_feature: GZ8MTXP02F7RY9.15.67.G01.1.454.CMB.2.raw
  modified_base (348)..(348): a, c, t, g, unknown or other
  modified_base (472)..(472): a, c, t, g, unknown or other
tcagtctacgtagccacgaccggtgctcgatttagagtatacatattgggtttgaggtctcagagaggagccttagccctggactcccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccagggccgggggggtccctggagactctcctgtgcagtctctggattcacccttagaagttatggatgacctgggtccgccaggctccgaggggagggctggagtgggtcggaccaaanaataaaacgaaaggacggaagtacaaagaaaaacctagtgtaggacttcagtaggaccggccgaattccacctatcctaccagacgaccaaacgaccaaagtacttacacttgtaactttgaanaaagtgaaacagccgtagagaggcggaaggaccgacggtcgtgtagttatgtgcgacgagatacggatagtactactacaacgaagtagacgaggtgtactgtattcg

SEQ ID NO: 371833 - DNA, 539 bp, Homo sapiens
  misc_feature: GZ8MTXP02GWUM5.15.67.G01.1.454.CMB.2.raw
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttattggatgacctgggtccgccaggctccaggggaaggggctgggagtggggtggccaacataaaacaaagacggaaagtcaagaaaaaacctagtagtaggactctgtagacggccgattcaccatctccagagacaacgccaaagattcactgtatttgacaaatgaaacagacctgagaggcggagacacggcgtgtattattgtgcgcgagatgatagtagactctanaagtagcaggtgtatgattcg

SEQ ID NO: 371834 - DNA, 658 bp, Homo sapiens
  misc_feature: GZ8MTXP02IPCRZ.15.67.G01.1.454.CMB.2.raw
  modified_base (347)..(347): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggagactctcctgtgcagtctctggattcacccttagaagttattggatgacctggtccgccaggctccgaggggagggctggaggtgggtggacccaaanataaaacgaaaaggaccggaagtaccaaagaaaaaaccctagtagtaggaaccttcgtaggttacggaaccggggccggtaactttacccaaccctaatccctacccgaagaacgaaccaaaccggacccaaaagaactttaccaacttaggttaatttagacctaaaagttcgaaaaccacgacccgtaggaagaacgggacggaggaaccggaccggtccggtagttattagttgtcgcgtacggagtagtagagtaagtacgactacgaactaagttaacgacgtaggtaggtatacggtaagtttgg

SEQ ID NO: 371835 - DNA, 566 bp, Homo sapiens
  misc_feature: GZ8MTXP02FMXQE.15.67.G01.1.454.CMB.2.raw
  modified_base (390)..(390): a, c, t, g, unknown or other
  modified_base (400)..(400): a, c, t, g, unknown or other
  modified_base (420)..(420): a, c, t, g, unknown or other
  modified_base (466)..(466): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgagggccgggggggtccctggagactctcctgtgcagtctctggattcacccttagagttattggatgacctgggtccgcaggctccgaggggaacggggctgggaggtggggtcggccaaacaataaaacgaaaaggacggaaagtacaagaaaaaccctntgtaggactntgtgacggcattcaccatcnccagagacaacgaccaagaattcactgtatttagacaaatgaaacnaccgtaggagaggacgaggaccgacggccgtgtattattgtgcggcgagatagatagtacgtactcgtaagaagtacgcgtagggtgtagtagtagttag

SEQ ID NO: 371836 - DNA, 541 bp, Homo sapiens
  misc_feature: GZ8MTXP02H0RA2.15.67.G01.1.454.CMB.2.raw
  modified_base (374)..(374): a, c, t, g, unknown or other
  modified_base (406)..(406): a, c, t, g, unknown or other
  modified_base (519)..(519): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttattggatgacctggtccgccaggcctccgagggaggggctggagtgggtggaccaacataaacaaagacggaagtcaaagaaaactntgtgactctgtgaacggccgattccaccatcnccagacgacacgccaagaatcactgtatttagacaaatagaacagcctagagaggcgaggacgacggcgtgtactagttgtgcgcgagagtgatagaagctactacagtaagngaggttggtatgagtacgtttg

SEQ ID NO: 371837 - DNA, 552 bp, Homo sapiens
  misc_feature: GZ8MTXP02IC98C.15.67.G01.1.454.CMB.2.raw
  modified_base (455)..(455): a, c, t, g, unknown or other
  modified_base (483)..(483): a, c, t, g, unknown or other
  modified_base (508)..(508): a, c, t, g, unknown or other
  modified_base (528)..(528): a, c, t, g, unknown or other
  modified_base (534)..(534): a, c, t, g, unknown or other
  modified_base (546)..(546): a, c, t, g, unknown or other
tcagtctacgtagccacgaccggtgctcgatttagagtatacatattgggtttgaggtctcagagaggagccttagcccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccaggcccgggggggtccctgagactctcctgtgcagtctctggattccaccttagaagtttatggatgacctgggtccgccaggctccgaggggagggctggaggtgggtggccaacaataaaacaaaggaacggaagtcaaagaaaacctatgtaggactctggtagacggccgtattccaccatccacagacgacaacgccaagactcatgtattgactaaatnaacagcctaggaggaggacggaggaacncggcgtgtattatgtcgcgacgganagtgagtagacgacttcganaagtancgtaggtggtangtactg

SEQ ID NO: 371838 - DNA, 704 bp, Homo sapiens
  misc_feature: GZ8MTXP02GDKHH.15.67.G01.1.454.CMB.2.raw
  modified_base (302)..(302): a, c, t, g, unknown or other
  modified_base (344)..(344): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgtagttatttagaagtgtcagtgtgaggtgcacttggtggagtcgtgggggaggcttggtccgaggccgggggggtccctggagactctcctgtgcagtctctggattcaccttagaagttattggatgaccgtgggtccnccgaggctccgaggggaaggggctggaggtgggtggaccaanaataaacgaaaggacggaaagtacaaaggaaaaaaccctgtgtacggaacttcgtggtacggaccggggccctaattcccaaaccctatccgttacccgaaaggaaacgaaccgaaacccggacccaaaaggtaaaactttcccaaacttgttaaattttagaaccctaaaaattcggaaaacaacggtccccgtaggaaccggacggggagggtaaacgggaaaccgtaccgggggtcccgttaggtttactttaagttggttacggccggagtaaaggattaggaaagttaacgttaaggaccttaccttaacgaaggtttacggacgtagggggttaacggtttagtagtagtttcg

SEQ ID NO: 371839 - DNA, 626 bp, Homo sapiens
  misc_feature: GZ8MTXP02ICG8I.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttgggtccagggcccgggggggtccctggagactctcctgtgcagtctctggattcaccttagagttatggatgaccgtggtccgccaggctccgaggggaaggggctgggaggtgggtgaccaaacgaataaaacgaaaggacggaaagtacaaagaaaaacctgtgtagactctaggtacgtaccgggccgtaattccaacctattccgaccagaaccgaacaaaccgaccaaagtaattccgaacttagttaatttacgactaaaatcgaaacagtcctaggagagggacgaaggacgacggaccgttagtatttaagttcgtagccggcgagagtacgagtaaacggttacgacttacctaagaagttacgacgtagggtagggttaatgtacgtttagg

SEQ ID NO: 371840 - DNA, 538 bp, Homo sapiens
  misc_feature: GZ8MTXP02INN2C.15.67.G01.1.454.CMB.2.raw
  modified_base (387)..(387): a, c, t, g, unknown or other
  modified_base (409)..(409): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccgggggggtccctgagactctcctgtgcagtctctggattcacccttagagttattggatgacctgggtccgccaggctccaggggaaggggctggagtggggtggccaacataaacaaagacgaagtcaagaaaacctatgtggactctgngacggccgattcacatctccanagacaacgaccaagattacactgtatttgacaaatgaaacagcctagagaggcggaaggacgacggaccgtgtattattgtgcgcgagataggatagtagtactctacaagtagcgaggtgtatgattg

SEQ ID NO: 371841 - DNA, 583 bp, Homo sapiens
  misc_feature: GZ8MTXP02IRSJW.15.67.G01.1.454.CMB.2.raw
  modified_base (429)..(429): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggagtcgtgggggaggcttggtccgagggcccggggggtccctggagactctcctgtgcagtctctggattcacccttagaagttattggatgacctgggtccgccaggctccgaggggaaggggcgtgggaggtggggtggcccaaaacataaaacgaaagacggaaagtacaagaaaaacctatgtaggactcgtgtgacgggccgattccaccatctccaganacaacgaccaaagaattcactgttaatttagactaaatacgaaacagacctaggagagggacggaaggaaccgacgggtccgtagttaatttagttgtcgcgacgagatgatagtacgactcgtaacaagtagacgtaggtggtatgtatttcg

SEQ ID NO: 371842 - DNA, 582 bp, Homo sapiens
  misc_feature: GZ8MTXP02FUK2S.15.67.G01.1.454.CMB.2.raw
  modified_base (381)..(381): a, c, t, g, unknown or other
  modified_base (410)..(410): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtcagtgtgaggtgcacttggtggagtcgtgggggaggcttggtccgaggccgggggggtccctggacgactctcctgtgcagtctctggattcacccttagaagttattggatgacctgggtccgccaggctccgaggggaaggggctgggagtggggtcgccaaacataaaacgaaagacggaagtacaagaaaacctntgtgactctgtgacggccattcaccatcnccagagacaacgccaaagattacacttgtatttagacaaatgaaacacgacctaggagacggacggaaggaccgacgggccgtagttattagttgtagcgacgagtagtgtaagtaacggttacgaacttacgaacgtaaggtacgacgtaagggtggtaatcggtatttgg

SEQ ID NO: 371843 - DNA, 535 bp, Homo sapiens
  misc_feature: GZ8MTXP02I09RH.15.67.G01.1.454.CMB.2.raw
  modified_base (269)..(269): a, c, t, g, unknown or other
  modified_base (304)..(304): a, c, t, g, unknown or other
  modified_base (406)..(406): a, c, t, g, unknown or other
  modified_base (511)..(511): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccatgagactctcctgtgcagtctctggnttcacccttagaagttattggatgacctgggtccnccaggctccgaggaggggctggagtgggtggaccaacataaacaaagacggaaagtcaagaaaaactgtgtaggactctgtgaacggccgattccaccatcncagacgaacaacgacaagaactcactgtatttgacaaatgaacagctgagaggacgagacgacggcgtgtattagtgtgcggcgagagtagaatagtacgactanaacgagtagcgaggtggtatgtag

SEQ ID NO: 371844 - DNA, 547 bp, Homo sapiens
  misc_feature: GZ8MTXP02J28Y2.15.67.G01.1.454.CMB.2.raw
  modified_base (347)..(347): a, c, t, g, unknown or other
  modified_base (376)..(376): a, c, t, g, unknown or other
  modified_base (379)..(379): a, c, t, g, unknown or other
  modified_base (386)..(386): a, c, t, g, unknown or other
  modified_base (431)..(431): a, c, t, g, unknown or other
  modified_base (512)..(512): a, c, t, g, unknown or other
  modified_base (516)..(516): a, c, t, g, unknown or other
  modified_base (521)..(521): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctggagactctcctgtgcagtctctggattcacccttagaagttattggatgacctgggtcccgccaggctccgaggggaagggctggagtgggtggccaanataaacaaagacgaaagtcaagaaaaccntgnggactcngtgacggcgatcacatctaccagagacaacgaccaaagatcactntaatttgactaaatgaaacagcctaggagaggcggaaggacaccggccgtagtattagtgtgcgcgagatggatacggtanactntaacngtaacggcgtaggtagtagtagtctg

SEQ ID NO: 371845 - DNA, 533 bp, Homo sapiens
  misc_feature: GZ8MTXP02JIR2T.15.67.G01.1.454.CMB.2.raw
  modified_base (490)..(490): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagagttatggatgacctgggtccgccaggctccgaggggaggggctggagtggggtggccaacataaaacaaagacggaagtacaagaaaaacctatgtaggactctgtgacggcatcaccatctccagagacaacgaccaaagattcactgtatttgacaaatgaaacagcctagagaggcgagacgacggcgtgtattagttgtgcgngagatgatagtacgactctacaagtatacgaggtgtactgatg

SEQ ID NO: 371846 - DNA, 548 bp, Homo sapiens
  misc_feature: GZ8MTXP02FENN3.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaaggggctgggagtggggtggccaaacgataaaacgaaaagacggaaagtcaagaaaaaacctatgtggactctgtgacggccgattcaccatctccagagacaaacgccaaagaattacactagtatttagcaaaatgaaacagcctgagaggacgaggacacggccgtgtattatgtagcgcgagattgatagtagactctaacaagtagcaggtggtaatggattcg

SEQ ID NO: 371847 - DNA, 552 bp, Homo sapiens
  misc_feature: GZ8MTXP02IWFHA.15.67.G01.1.454.CMB.2.raw
  modified_base (506)..(506): a, c, t, g, unknown or other
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgaccgtgggtccgccaggctccgaggggaaggggctgggagtgggtggccaaacataaacaaagacggaagtacgaagaaaaacctgtagtggactctaggtgacggccgattccacctatctccagacgacaacgccaaagattcactgtatttgacaaatgaaacagcctagagagggcgaggacgacgggcgtgtattatgtgcgtcgganagtgaatagtanacgtctacgaagtacgcgaggtgtagtgagtttg

SEQ ID NO: 371848 - DNA, 658 bp, Homo sapiens
  misc_feature: GZ8MTXP02JIEHT.15.67.G01.1.454.CMB.2.raw
  modified_base (262)..(262): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctggagactctcctgtgcngtctctggattcacccttagaagttatggatgacctgggtccgccaggctccgaggggaagggcgtggaggtggggtggtacaaacgataaaacgaaagaacggaaagtacaaagaaaaacctagtagtaggactcgtagtacgacgggccgtaattccgaaccagtacctacccaaaggaacgaaaccgaaacccgacccaaaaggtaaacttacgaaccttagttaagtttacgaacctaaaattagaaaccaagtacccgtaggaaggacgggacgggaaacgggtacgaccgggaccgttagtagttagttggtgcggtacgaggtatagaattaggtaactaccgtactaacgtaaggtaaggacgtagggtaggtatacggtagtttagg

SEQ ID NO: 371849 - DNA, 781 bp, Homo sapiens
  misc_feature: GZ8MTXP02HGMBE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccggggggtccctggagactcctcctgtgcagtctcgtggattcaccttagaagttattggatcgaccgtggtccgccgaggctccgaggggaaggggcgtgggtaggtggggtcggacccaaaacgtaaagtaaaaacgaaaggaaacggaagtaacaaagaaaaacctagtgtacgtactcgtaggtacgaccgggccgtaacgttaccacctactccctaccgaaacgaaccgaaaccaaaacccggaccctaaaacggtaactttacccgaacgtttagtttaactttttacggaaaccttaaaaagttcggaaaaaccgtacggtacccgtaagggaacgggaacggggaccgggtaaacggggtaaaccgttaaccgggggtccccgtttaaagggtttacgtttaaaggtttcgggtacgggtacccggtaacggaaagggtaatttagggaaaacgtttaaggttaacggtaaccttaccgtttaaacgaagggttaacggtacgtagggggtttaagtacggttagggtaactttaggg

SEQ ID NO: 371850 - DNA, 540 bp, Homo sapiens
  misc_feature: GZ8MTXP02GAHN8.15.67.G01.1.454.CMB.2.raw
  modified_base (418)..(418): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttattggatgacctgggtccgccaggctccgaggggaaggggctgggaggtgggtggccaacataaacaaagacggaagtcaagaaaaacctatagtggactcgtgtgaccggccgattcaccatctccaganacaacgccaaagaattcactgtatttgacaaaatgaaacagcctgagaggcgagacacggcgtgtattatgtgcgcgagatggaatagtagactctacaagtagcgaggtggtatgagtttg

SEQ ID NO: 371851 - DNA, 539 bp, Homo sapiens
  misc_feature: GZ8MTXP02GXOB3.15.67.G01.1.454.CMB.2.raw
  modified_base (372)..(372): a, c, t, g, unknown or other
  modified_base (410)..(410): a, c, t, g, unknown or other
  modified_base (491)..(491): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttatggatgacctggtccgccaggctccaggggaaggggctggagtgggtggccaacataaacaaagacggaagtcaagaaaaacctanagtggactctgtgacgggccgattcaccatctccaganacaacgccaaagaatcactagtatttgacaaatgaaacagcctagacgagggcgaggacacggccgtgtattattgtgcgngagatgatacgtagactctaacngtaagcgtaggtggtatggatttgg

SEQ ID NO: 371852 - DNA, 701 bp, Homo sapiens
  misc_feature: GZ8MTXP02HMNBK.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggttttccttgttgttatttagaaggtgtcagtgtgaggtgcacttggtggagtcgtgggggagcttggtccaggccggggggtcctgagactctcctgtgcgtgtctcgtggtacttccctaccgttaagtaagtttagtggtatacgtaccggttcgggtcccgaccgacggcctaccggaagggggaacggggcggtgggtaggtggggtcggaacccaaacgaaactaaaaacgaaaacggaacgggtaaagtacaaaaggtaaaaacctagtaggtacgacttcgtaggtacggaccgggacgtacttaccaacctactacctacgaacggaacgaaccgaaaccgacccaaaagttacttaacccgtattacgtttatttacgaaactaaagttacgaaaactacgaccgttaggaaggacgggacggaacggaacgaccgggtacgttagttaacttagttgcgacggacgagtagtagaagttaagtacgtacgttactaacgaaggtacgtacggtagggtagttagacgttagtttcgg

SEQ ID NO: 371853 - DNA, 561 bp, Homo sapiens
  misc_feature: GZ8MTXP02F8RLW.15.67.G01.1.454.CMB.2.raw
  modified_base (415)..(415): a, c, t, g, unknown or other
  modified_base (455)..(455): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccaggggaagggctggagtggggtggccaacataaaacaaaagacggaagtcaagaaaaacctatagtaggaactctagtgacgggccgattcaccatctccanagacaacgccaaagaattcactgtatttgcaaatagaaanagacctgagaggacgagacgacgaccgtgtattatagtgcgcgagagtagataagtaggtaacgtacttaccaagttaacgacgaggtaggtagtagtaagtttgg

SEQ ID NO: 371854 - DNA, 539 bp, Homo sapiens
  misc_feature: GZ8MTXP02IL19N.15.67.G01.1.454.CMB.2.raw
  modified_base (451)..(451): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggggttttccttgttgttattttagaaggtgtccagtgtgaggtgcacttggtggagtcgtgggggaggcttggtccaggcccgggggggtccctgagactctcctgtgcagtctctggattcacccttagaagttattggatgacctgggtccgccaggctccaggggaaggggctgggagtgggtggccaacataaacaaagacggaagtacaagaaaaacctatgtaggactctgtgacggccgattcaccatctcagagacaacgcaagaattcactgtattgacaaatgaaacngcctagagaggcgaggacacggccgtagtacttattgagtcgacgagatgatagtagacctgtaacaagtacgcgtaggtgtatgatg

SEQ ID NO: 371855 - DNA, 608 bp, Homo sapiens
  misc_feature: GZ8MTXP02IVXE6.15.67.G01.1.454.CMB.2.raw
  modified_base (301)..(301): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagagttatgatgacctgggtccncaggctccgaggggaaggggctgggagtggggtggccaaacataaaacaaagacgaagtcaagaaaaacctatgtaggactcgtgtgaacggccgattcaccaatctaccgagagactaaacgacccaaagaattacactgtaatttgactaaaatgaaacagccgtagagacggacgaggaccgacggccgttagtaagtttaagttggtagcgacggaagtagtaggaaacttaggtaacgtaacgtttaccaaaccgtaaggttaaccgacgtaaaggggtaggttacgtacgaacgtttaggg

SEQ ID NO: 371856 - DNA, 545 bp, Homo sapiens
  misc_feature: GZ8MTXP02GHEH9.15.67.G01.1.454.CMB.2.raw
  modified_base (304)..(304): a, c, t, g, unknown or other
  modified_base (341)..(341): a, c, t, g, unknown or other
  modified_base (374)..(374): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccnccaggctccaggggagggctggagtggggtgccaaanataaaacaaagacggaagtcaagaaaaaacctntgtaggaactcgtgtagaccgggccgattcaaccatctccagagacaaacgccaaagaattcaactgtatttgacaaatgaaacagcctgagaggacgagaccacggcgtgtattatgtgcgcgtagatgaatagagactctaacaagtagcgtagggtgtaatcgatttg

SEQ ID NO: 371857 - DNA, 580 bp, Homo sapiens
  misc_feature: GZ8MTXP02GW3HC.15.67.G01.1.454.CMB.2.raw
  modified_base (390)..(390): a, c, t, g, unknown or other
  modified_base (427)..(427): a, c, t, g, unknown or other
  modified_base (455)..(455): a, c, t, g, unknown or other
  modified_base (472)..(472): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtcctgagactctcctgtgcagtctctggattccacccttagaagttattggatgaccgtgggtcccgccaggctccgaggggaacggggctggaggtggggtcggccaaacaataaaacgaaaggaacggaagtacaagaaaaaacctntgtacggactctgtagaccggcgattccgaccatccnccagacgacaacgacaaagattcacttntactttgactaaagtanaaacagcctaggagagggcgaaggaccgacggccgtagtattagtgtagcgacgagatacgagttaagtacgactactagaagtacgcgtaggtaggtatggtatcgg

SEQ ID NO: 371858 - DNA, 630 bp, Homo sapiens
  misc_feature: GZ8MTXP02F8PC0.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgagggccggggggtccctggagactctcctgtgcagtctctggattcacccttagagttatggatgctggtccgcaggctcgagggagggctggagtgggtggaccaaacataaacgaaagacggaatacgaagaaaaacctgtagtggactcgtgtacgacgggccgaattccaaccatcctaccgagaacgaacaaaccgaccaaagacttcaacttgttaatttacgaactaaaagtgaaaacgagtaccgaggaaggaggacgggaaggtaacccggacgggtaccgttagttaaagtttagtttcgggtaggccggtacggtaaggaagttcgtaaagttaaggtacgtaacgtaccttaacgaaggttagaccgtagggtagtagtggtactttgg

SEQ ID NO: 371859 - DNA, 632 bp, Homo sapiens
  misc_feature: GZ8MTXP02GPWO8.15.67.G01.1.454.CMB.2.raw
  modified_base (307)..(307): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctggagactctcctgtgcagtctctggattcacccttagaagttatggatgacctgggtcccnccaggctccgaggggaagggctggaggtggggtggaccaaagaataaaacgaaaggacggaaagtacgaaagaaaaaacctagtaggtagggaactcgtaggtacgaccggggccattaccaaccatcctccgaagacgaaccaaaccggcccaaagtacttcccattggttaatttgaactaaaatgaaaaccgagccgttaggaggaggaccgggaaggaccgaacgggccgttgttaacttagttggtcgcgacgagtacgtgtaatagtaacgtactacttaacgaagttagacgtaggggttagagttacgaagttttcg

SEQ ID NO: 371860 - DNA, 547 bp, Homo sapiens
  misc_feature: GZ8MTXP02GK6UA.15.67.G01.1.454.CMB.2.raw
  modified_base (408)..(408): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccgccaggctccgaggggaaggggctgggagtggggtggccaacataaaacaaagacggaagtcaagaaaaacctatgtaggactctgtgacgggccattcaccatcnccagagacaacgccaaagatcactgtatttgacaaatgaaacagacctggagaggacggaggaccgacgggtccgtggtaatttagttgtgcgcgagatgatagtacgactctacgaagtagcgaggtgtagtgtagtg

SEQ ID NO: 371861 - DNA, 589 bp, Homo sapiens
  misc_feature: GZ8MTXP02G5653.15.67.G01.1.454.CMB.2.raw
  modified_base (346)..(346): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctcgaaggggaaggggctggaggtgggtggaccaaanaataaaacaaaggaacggaaagtacgaagaaaaaccctagtgtaggactcgtgtacggacggccgattccgaccatcctaccagacgaacaaaccgacccaaagtaacttacgaacttgtaatttagactaaaatgaaacagacctagaaggacggacggaaggaccgacgggaccgtagtattaagttgtgccgagagatacgatagtagactctacgaagtagacgtaggtgtactgattg

SEQ ID NO: 371862 - DNA, 621 bp, Homo sapiens
  misc_feature: GZ8MTXP02JEY9H.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggagactctcctgtgcagtctctggattcacccttagaagttatggatgacctgggtccgccaggctccgaggggaagggctgggaggtgggtcggaccaacgaaataaaacgaaaggaacggaagtacaaagtaaaaacctgtagtaggacttcgtggtagaccggccattccgaaccatcctaccaagacgaaccaacgaccaaagaattacactgttatttagacctaaagtacgtaaacgacgtaccgtaggaacggagggacgggaacggaaccgacgggtcccggtagtacttagttcggtcgcgtacggagtagtgaataaggtacgactacgtacaagtacgacgtaggtggtaacgtgtatttacg

SEQ ID NO: 371863 - DNA, 774 bp, Homo sapiens
  misc_feature: GZ8MTXP02F8Z0I.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggagtcggtgggggaggtcgttcgggtccgagggcccgggggggttccctggacgaccttcctcctgtgcagtctcgtggacttccacccttagaagttattggatcgaccgtcggtccgcgaggctccggaggggacggggcgtgggaggtggggtcggacccaaaactaaacgtaaaacgaaaaggaaccggtaaagtaaccgaaaagtaaaaaaccccttgtacggtacggaccttcgtacggttacggaaccccggggtccgtaactttacccaaccctacttccgtacccgaaagaacgaaacccaaaccggacccaaaagtaactttacaaccgttgttaacttttaggaaaccaaaagttacgaaaaccgtaggtacccgtaggaacgggaacgggaccgggaagggaacccggaccgggtaccgtttaggttaaacgtttagttcggttacggtaccggacgggtaagtagttagggtaaagttaacggtaaacgtaccttaccgttaacgaaggttaaccggacggttaaaaggggtggttaacgttggtaacgtttttcgg

SEQ ID NO: 371864 - DNA, 659 bp, Homo sapiens
  misc_feature: GZ8MTXP02JLHP1.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttgggtccaggccggggggtccctgagactctcctgtgcagtctctggattcacccttagaagttattggatgaccgtgggtccgccaggctccgaggggaaggggcgtgggagtggggtggccaaacaataaaacaaaggaacggaagtacaagaaaaaccctatagtaggaactcgtagtagaccggccgattccacctatctccagagacaaaccgaccaaagaattacactagtactttagactaaaatacgaaacagtacctaggaaggaagggacggaaacggaaccgtaaccggggacccggttaggttaagtttaagttacggtagccgtacgggagaagttcggaaagttaacggttaagtaaccgttacccgttaacgaaaggtagtaccgtaaggggttacggtacgttaccggtagtttaaccgg

SEQ ID NO: 371865 - DNA, 552 bp, Homo sapiens
  misc_feature: GZ8MTXP02FWNCR.15.67.G01.1.454.CMB.2.raw
  modified_base (412)..(412): a, c, t, g, unknown or other
  modified_base (510)..(510): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgacctgggtccgccaggctccgaggggaaggggctggagtgggtggccaaacataaaacaaaggacggaagtacaagaaaaacctatgtaggactctagtgacggccgattcaccatcnccagaagacaaacgacccaaagaacttcactgtaatttagacaaaatgaaacagacctagaagaggacgagacgacggcgtagtattatgtgcgcganatgatagtacgactctaacaagtagacgaggtagtatgattg

SEQ ID NO: 371866 - DNA, 821 bp, Homo sapiens
  misc_feature: GZ8MTXP02JUZD9.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagagttattggatgaccgtgggtccgccaggctccgaggggaagggcgtggaggtggggtcggacccaaacaataaaaacgaaaaggaaccggaaagtaccgaaagaaaaaaccctagtagtacgggaacttcgtaggttacggaacccgggggccgtaacgtttacccaacccgtaacgttcccgttaccccgaaaggaaacccggaaacccgaaaacccggaacccccgaaaaggtaaaacttttacccgaaacgtttacggttaactttttagggaaaccctaaaaagttacgaaaaaccacgggacccttaaggggaaggaacggggccggggaaaacggggaacccgtaaccgggggtacccggtttaggtttaaagtttttaacggtttgggtacggggtaacccggggtacgggtaaacggtaaggttacgggtaaagttaaacgggttacgtaacccgttaaccggtaaacggtaagggttaacgggtacgggttaaggggttacgggttaacggttacggttaacggtttgg

SEQ ID NO: 371867 - DNA, 544 bp, Homo sapiens
  misc_feature: GZ8MTXP02ID10V.15.67.G01.1.454.CMB.2.raw
  modified_base (346)..(346): a, c, t, g, unknown or other
  modified_base (376)..(376): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccaggccgggggggtccctgagactctcctgtgcagtctctggattcacccttagaagttattggatgacctgggtccgccaggctccgaggggaggggctgggagtgggtggccaaanataaacaaagacgaagtcaagaaaacctangtgactctgtgacggcgattccaccatctccagagacaaacgaccaaagtaaacttcactgttaatttgactaaatgaaacagccctagacgaggcgaggacgtacggacgtgtattatgtgcgacgagatgatacgtagacttcagaagtagactaggtgtatgatg

SEQ ID NO: 371868 - DNA, 547 bp, Homo sapiens
  misc_feature: GZ8MTXP02JP3M8.15.67.G01.1.454.CMB.2.raw
  modified_base (417)..(417): a, c, t, g, unknown or other
  modified_base (525)..(525): a, c, t, g, unknown or other
  modified_base (533)..(533): a, c, t, g, unknown or other
  modified_base (541)..(541): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccaggcccgggggggtccctgagactctcctgtgcagtctctggattcacccttagaagttattggatgaccgtgggtccgccaggctccgaggggaaggggctgggagtggggtggaccaacataaaacaaagacggaagtacaagaaaaacctatgtaggactctgtagacggccgattccaccatcnccagagacaacgacaagaatcactgtatttagacaaatagaaacagcctagagaggacggagacgacgcggtgtattagtgtgcgcgtagatgatagtacgactctanaagtacgnaggtgtangtatcg

SEQ ID NO: 371869 - DNA, 587 bp, Homo sapiens
  misc_feature: GZ8MTXP02GKX5X.15.67.G01.1.454.CMB.2.raw
  modified_base (478)..(478): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcctggtccagggccggggggtccctgagactctcctgtgcagtctctggattcacccttagagttatggatgaccgtggtccgccaggctccgaggggaagggctgggagtgggtggaccaaacaataaaacgaaaggacggaagtacaaagaaaaacccttgagtaggactcgtagtagacgggccgtattacaccatcctcgagacgaacaacgaccaaagaattcactgtaatttagtaaatgaacagcctagagnggacggagacgacggtccgtagttaattagtgttcgcggtacgagagtgaaagtacgtaacgacttctaacgtagtaagacgaggttaggtagttgaacgttgtttacg

SEQ ID NO: 371870 - DNA, 717 bp, Homo sapiens
  misc_feature: GZ8MTXP02GPIX0.15.67.G01.1.454.CMB.2.raw
tcagtctacgtagccacgaccggtgctcgatttagagtatacatatttgggtttgaggtctcagagaggagccttagccctggactccaaggcctttccacttggtgatcagcactgagcacagaggactcaccatggagttgggctgagtcttgggttttccttgttgttattttagaaggtgtccagtgtgaggtgctacgttggtggagtcggtgggggaggtcgttggtccgagggcccggggggttccctggacgtacctctcctgtcgctagtctcgtggtacttccaccttagtaagttagttggatcggaccgtcgggtccgccgaggccgtccggaagggggtaacgggcgtagggaggtaggggtcggaaccaaaactaaacgtaaaaacgaaaggaaccggaaagtacgaaaacgtaaaaacctagtgtacggtacttcgtaggtacgaccgggtacctattaccgacctactacctacgaagaaacgaaccgaaaccgacccgaaaagttaaacttccgtaacgttagttaagtttacgaactaaaagttcgaaaacctacggacctagggacggaacgggacggaacggaaccggtacggtaccgtagtttaaagtgttagtcggacgacggtagattagggaaattacggtaacgtacttacgttaagaaggttacgagtagggttagtagtacggtatttgg

SEQ ID NO: 371871 - DNA, 571 bp, Homo sapiens
  misc_feature: GZ8MTXP02GPFSO.15.67.G01.1.454.CMB.2.raw
  modified_base (384)..(384): a, c, t, g, unknown or other
  modified_base (388)..(388): a, c, t, g, unknown or other
  modified_base (421)..(421): a, c, t, g, unknown or other
  modified_base (517)..(517): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggctttggtccgaggccgggggggtccctgagactctcctgtgcagtctctggattcacccttagaagttattggatgacctgggtccgccaggctccgaggggaagggcgtggaggtgggtggaccaacaataaacaaaagacggaagtacaagaaaaaccctntagnggactctagtgacggccgattcaccatctccanagacaaacgccaaagaattcactgttatttagacaaaatgaaacagtcctagagaggacggaggaaccgacgggaccgtgttaatttagtgtgcgngaagagtgaatagtacgaactactaacaagtagcgaagggtgtatggaatttcg

SEQ ID NO: 371872 - DNA, 548 bp, Homo sapiens
  misc_feature: GZ8MTXP02GJPE5.15.67.G01.1.454.CMB.2.raw
  modified_base (339)..(339): a, c, t, g, unknown or other
  modified_base (370)..(370): a, c, t, g, unknown or other
  modified_base (400)..(400): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccgggggggtccctgagactctcctgtgcagtctctggattcacccttagagttattggatgacctggtccgccaggctccgaggggagggctggagtgggtgaccaanataaacaaagacgaagtacaagaaaaacctntgtaggactctgtagacgcgattcacatcncgagagacaacgccaagattcactgtatttgactaaatgaaacagacctgagaggacgagacgacggcgtagtatttagtgtgacgtcgagagtagtagtagtagtacgtactacgtaagtacgtacgaggtaggtagtagtagttag

SEQ ID NO: 371873 - DNA, 688 bp, Homo sapiens
  misc_feature: GZ8MTXP02INI6S.15.67.G01.1.454.CMB.2.raw
tcagtctacgtagccacgaccggtgctcgatttagagtatacatattgggtttgaggtctcagagaggagccttagcccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggattctacccttagaagttattggatgaccgtgggtcccgccgagctccgaggggaagggcgtgggagtgggtggaccaaagaactaaaacgaaaggaacggaaagtacaaagaaaaaacctagtagtaggacttctggtacgaccgggtcctaattcccaaccgtacgtcctacctagaaacgaaccgtaaaccgacccaaagtaattaccgacttagttatttagaactaaatagaaaccacgtacccgaggtaacggaacgggaccgggaaacggaccgtaaccggggtacccgttaggttaaacgtttaagtttcggtcggaccggtaccggaagtaagttagtaaaggttacgttaaacgtaccgttacgtaacgtaagttacgacgtagggttagtagtacgtatttcgg

SEQ ID NO: 371874 - DNA, 525 bp, Homo sapiens
  misc_feature: GZ8MTXP02F27SY.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccaggggaaggggctggagtgggtggccaacataaacaaagacggaagtcaagaaaaacctatgtggactctgtgacggcgattcaccatctcagagacaacgccaaagattcactgttattgacaaatgaacagcctgagaggcgagacacggccgtgtattatgtgcgacgagatgatagagtactctacaagtcgataggtggtatgattg

SEQ ID NO: 371875 - DNA, 739 bp, Homo sapiens
  misc_feature: GZ8MTXP02HFT90.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggattcacccttagaagttatggatgacctgggtccgcaggctccgaggggaaggggctgggagtggggtcggaccaaacataaaacaaaggaacggaagtacaaagaaaaaccctatgtaggactctggtacgacgggccgtaattccgacctaatcctacccaaggaacgaacgaaacccggacccaaagtaaactttacccaacttaggttaattttacggaacctaaaaagtacgtaaaacctaacggaccccgttagggaaacggtaggggacccgggaaagggaaacccggaacccgggggtaccccggtttacggttaacgtttaacggtttagggttacggcccggtacgggaaaggtagttacggaaagtttaaaggtaacggaacccgttacttaaaccgtaaggttaaaggaccggttaaacggggttagggttaacgtttacggtacgtttaacggg

SEQ ID NO: 371876 - DNA, 577 bp, Homo sapiens
  misc_feature: GZ8MTXP02G3W24.15.67.G01.1.454.CMB.2.raw
  modified_base (387)..(387): a, c, t, g, unknown or other
  modified_base (418)..(418): a, c, t, g, unknown or other
  modified_base (439)..(439): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgagggcccgggggggtccctgagactctcctgtgcagtctctggattcacccttagaagttattggatgacctgggtccgcaggctccgaggggaaggggctgggaggtggggtggaccaaacataaaacaaaggaacggaagtacaagaaaaaccctntagtggactgtgtgacggcatcacatctcanagacaacgacaagaatcactntatttgactaaatacgaacacgaccgtagaggacgacggaggaccgacgggtcgtagtaattacgttgtgcgacgagagtagtagtacgtacgtaactacgtaacgaagtagacgtagggtaggtatcggtaatttgg

SEQ ID NO: 371877 - DNA, 611 bp, Homo sapiens
  misc_feature: GZ8MTXP02GKBR6.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattgggatgaccgtgggtcccgccaggctccgaggggaaggggctggaggtgggtggccaaacaataaaacgaaagacggaagtacaagaaaaacctgtagtaggactcgtgtgacggccgattcaccatcaccagacgacaaacgccaaagattacactagttatttacgacaaatagaaacagacctaggaaggagggacgggaacgacgacgggtccgtagttaagttagttggtagccgacgaagtagtagtaagtacggttaacgaccttacgtaaccgtaaggttaggacgtaggggttaggtaacgtgtaagtttcgg

SEQ ID NO: 371878 - DNA, 601 bp, Homo sapiens
  misc_feature: GZ8MTXP02I17Q5.15.67.G01.1.454.CMB.2.raw
  modified_base (388)..(388): a, c, t, g, unknown or other
  modified_base (401)..(401): a, c, t, g, unknown or other
  modified_base (410)..(410): a, c, t, g, unknown or other
  modified_base (480)..(480): a, c, t, g, unknown or other
  modified_base (500)..(500): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtgggaggttcgtggggggagggcgtttgggttcccgagggcccggggggggtccctggagacctctcctgtgcagtctctggattcacccttagaagttattggatgaccgtgggtccgccaggctccgaggggaaggggctggagtggggtggcccaaacgataaaacaaagaacggaagtanaagtaaaaacctnagtggactntgtagacggcgacttcaacccatctccaagacgaacaaccgccaaagaattcacttgtatttgacaaatnaaaccagcctaggagagggnggaacggaccgacggccgtgtaatttatggtagcgacgaggattagaagttagtacgacttcgtaactaaggtagacgaggggtagtaagttgagtttacg

SEQ ID NO: 371879 - DNA, 665 bp, Homo sapiens
  misc_feature: GZ8MTXP02F36AV.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttcctgttgttattttagaaggtgtccagtgtgaggtgcacgttggtggagtcgtgggggaggcgttggtccgaggcccggggggtccctgagactctcctgtgctagtctcgtggtattcacccttagaagttattggatcgacctcggtccgccgaggctccgaggggaaggtcgtggaggtggggtcggaccaaacgaataaaacgaaaggacggaaagtaccaaaggtaaaaacctgtagtaggacttcgtaggtacggaccggtaccgtaacttaccaccctactactaccgaaagaaccgaaaccgaaccgaacccgaaaagtacttacgtaacttaggttatttaaccgactaaaatacgaaacgtacgtacccgagggaagacgggacgggaacgaccgtaccgggtacgttagttaaagttagttgtacgcggtacgtagtagagtaacgtaggtacaacttacgacgtaagacgacgtagggttagagtacgtagtttg

SEQ ID NO: 371880 - DNA, 534 bp, Homo sapiens
  misc_feature: GZ8MTXP02HRUUU.15.67.G01.1.454.CMB.2.raw
  modified_base (344)..(344): a, c, t, g, unknown or other
  modified_base (378)..(378): a, c, t, g, unknown or other
  modified_base (390)..(390): a, c, t, g, unknown or other
  modified_base (412)..(412): a, c, t, g, unknown or other
  modified_base (443)..(443): a, c, t, g, unknown or other
  modified_base (466)..(466): a, c, t, g, unknown or other
  modified_base (481)..(481): a, c, t, g, unknown or other
  modified_base (485)..(485): a, c, t, g, unknown or other
  modified_base (490)..(490): a, c, t, g, unknown or other
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttgggtggagtcgtgggggaggcttggtccgaggcccgggggggtccctggagactctcctgtgcagtctctggattcaccctagaagttatggatgactggtccgcaggctccgaggggaagggctgggagtggggtggccaaanaataaaacaaagacggaagtcaaagaaaaacctntagtgactgtgngacggcgatcaccatctcaganacacgcaaagattcactgtattgactaaatnaacagcctagagaggcgagaacncggcgtgtattatgngcgngagtntgatacgcgactgtacaaggtnacgtaggagttagtgtactttg

SEQ ID NO: 371881 - DNA, 555 bp, Homo sapiens
  misc_feature: GZ8MTXP02GXABU.15.67.G01.1.454.CMB.2.raw
  modified_base (270)..(270): a, c, t, g, unknown or other
  modified_base (345)..(345): a, c, t, g, unknown or other
  modified_base (415)..(415): a, c, t, g, unknown or other
  modified_base (491)..(491): a, c, t, g, unknown or other
  modified_base (522)..(522): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggagcttggtccgaggcccgggggggtccctggacgactctcctgtgcagtctntggattccacccttagaagttattggatgacctggtccgcaggctccgagggaggggctggagtggtgaccaaanataaaacgaaagacggaaagtcaaagaaaaactagtagtagactcgtagtaggaacgccgtatcacatcncagagacacgacaaagatacatgtattgacaatagaacagcctgacgagcgaggacacggcgtagttattattagngcgcgtagagtgaagtagtagacttacgaanagtaagacgtaggtaggtatcgaattcgtttcg

SEQ ID NO: 371882 - DNA, 563 bp, Homo sapiens
  misc_feature: GZ8MTXP02HF0YZ.15.67.G01.1.454.CMB.2.raw
  modified_base (410)..(410): a, c, t, g, unknown or other
  modified_base (415)..(415): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctggagactctcctgtgcagtctctggattcacccttagaagttattggatgacctgggtcccgccaggctccgaggggagggctgggagtgggtggccaaacataaaacaaagacggaagtacaagaaaacctatgtagactctgtagacggcgattcaccatcncaganacaacgcaagatcactgtattgactaaatcgaaacacgcctaggaagaggacggaacggacgacgggccgttagtattagttgtagcgtacgagagtgaagtagtacgactacgtaacgaagtaagcgaggttggtactggatttcgg

SEQ ID NO: 371883 - DNA, 609 bp, Homo sapiens
  misc_feature: GZ8MTXP02FYRFG.15.67.G01.1.454.CMB.2.raw
  modified_base (525)..(525): a, c, t, g, unknown or other
  modified_base (600)..(600): a, c, t, g, unknown or other
  modified_base (605)..(605): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggtttccttgttgttatttagaaggtgtccagtgtgaggtgcacttgggtggagtcgtgggggagggcttggtccagggccggggggtccctgagactctcctgtgcagtctctggattcacccttagaagttattggatgacctgggtccgccaggcctaccgaggggaaggggctgggaggtggggtggacccaaacaataaaacgaaaaggaacggaaagtacaaaggaaaaaaccctagtgtaggacttcgtaggtacgaaccgggccgaatttccaccctaattccaccgaagacgaaccaaaccgaccaaagaattcactgttatttgacaaaatgaaactagcctaggagaggacggaggaaccgngggaccgtgttattatggtcgcgacggatagtggactaagtacgtacctcttaagaagtacgacgaggtggttanacgtnttag

SEQ ID NO: 371884 - DNA, 554 bp, Homo sapiens
  misc_feature: GZ8MTXP02JHSW0.15.67.G01.1.454.CMB.2.raw
  modified_base (343)..(343): a, c, t, g, unknown or other
  modified_base (372)..(372): a, c, t, g, unknown or other
  modified_base (376)..(376): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtcagtgtgaggtgcacttggtggagtcgtgggggaggcttggtccgaggcccgggggggtccctggagactctcctgtgcagtctctggattcacccttagaagttattggatgacctgggtccgccaggctccaggggagggctggagtgggtggccaanataaacaaagacgaatcaagaaaaacctntagngactctgtgacggcgatcacatctcagagacaacgaccaagattacactgtatttagactaaatgaaacacgacctaggacggagggacggaacggacgaccgggaccgttagtaattagttgtagcgacgagagtgagtagtacgactacacgaagtagacgtaggtgtagtgattg

SEQ ID NO: 371885 - DNA, 601 bp, Homo sapiens
  misc_feature: GZ8MTXP02G3PTW.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccgagggcccgggggggtccctggagactctcctgtgcagtctctggattcaccttagagttatgatgacctggtccgcaggctccgagggagggctggagtggtgcaacataaaacgaaagaacggaagtacaaagaaaaacctagtcgtaggactcgtgtagaccgggccgtattaccaccatctccgaaagacgaaccaaaccgacaaacgtaattaccgaacttagttaatttacgactaaaagttcgaaacgacgtaccgtaggaacggagggacggaaggaccgaacggccgtagtattagttgtgacgacgagatgaactagttacgactactacgaagttaggacgtaggtagtataggatttagg

SEQ ID NO: 371886 - DNA, 564 bp, Homo sapiens
  misc_feature: GZ8MTXP02HRE6O.15.67.G01.1.454.CMB.2.raw
  modified_base (344)..(344): a, c, t, g, unknown or other
  modified_base (385)..(385): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtcctgagactctcctgtgcagtctctggattcacccttagaagttattggatgacctgggtccgccaggctccgaggggaggggctggaggtggggtggccaanataaaacaaagacggaagtcaagaaaacctatagtggactntgagacggccgatcaccatctccagacgacaacgaccaaagattcacttgttactttagacaaatgaaacagcctagagaggacggaggaccgacggccgtagttagttagttggtagcgacgaggtatagaagtagttacgacttactagaagttagacgtaggtgtatggtatttcg

SEQ ID NO: 371887 - DNA, 592 bp, Homo sapiens
  misc_feature: GZ8MTXP02HK563.15.67.G01.1.454.CMB.2.raw
  modified_base (272)..(272): a, c, t, g, unknown or other
  modified_base (471)..(471): a, c, t, g, unknown or other
  modified_base (481)..(481): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccagggcccggggggtccctgagactctcctgtgcagtctctggnttcacccttagagttatggatgaccgtggtccgccaggcctccgaggggaagggcgtgggaggtgggtggccaaacaataaaacgaaagacggaaagtacgaaagtaaaaacctatagtaggacttcgtggtagaccgggccgtattccacctatcgtaccagacgaacaaccgaccaaagacttcactgtatttaganaaatgaaacngactgagaggaggagaccgacggcgttagtattagttgtcgacggacgtaagattaaataggaactactactacgaagtaacgagtaggttaggtagtagtattcgtttag

SEQ ID NO: 371888 - DNA, 580 bp, Homo sapiens
  misc_feature: GZ8MTXP02GD6ST.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaagggctggagtggggtggccaacataaacaaaaggacggaaagtcaaagaaaaacctagtgtaggactctgtgaccgggccgattcaccatcctaccagacacaaccgaccaaagaattcactgtatttgacaaaatgaaactagcctaggagagggcgaaggacacgggccgtgtaagttacttggtcgcggtcgaagagtagaagttagacgtactcgtaacgaaggttagcgtagggtagtacgtggtaactttgg

SEQ ID NO: 371889 - DNA, 565 bp, Homo sapiens
  misc_feature: GZ8MTXP02FODGW.15.67.G01.1.454.CMB.2.raw
  modified_base (305)..(305): a, c, t, g, unknown or other
  modified_base (341)..(341): a, c, t, g, unknown or other
  modified_base (469)..(469): a, c, t, g, unknown or other
tcagtctacgtagccacgaccggtgctcgatttagagtatacatattgggtttgaggtctcagagaggagccttagccctggactccaaggcctttccacttggtgatcagcactgagcgcagaggactcaccatggagttggggctgagctgggttttccttgttgttattttagaaggtgtccagtgtgaggtgcacttggtggagtcgtggggggaggcttggtccgaggccgggggggtccctggagactctcctgtgcagtctctggattcaccttagaagttatggatgacctggtccncaggctcgaggggagggctggagtgggtggccaaanataaaacgaaagacggaatacaaagaaaaaccctgtggtagactcgtaggtagaccgggccgaattccacctatctccaagacgaacaaaccgccaaagaacttcactgtatttgacaaatcgaaacngcctaggagaggacggagtacgacggtcgtagttattagtgtgcgagagatgaatagtacgactctaagaagtaaggacgtaggtagtatgtatcg

SEQ ID NO: 371890 - DNA, 552 bp, Homo sapiens
  misc_feature: GZ8MTXP02G9WO8.15.67.G01.1.454.CMB.2.raw
  modified_base (383)..(383): a, c, t, g, unknown or other
  modified_base (408)..(408): a, c, t, g, unknown or other
  modified_base (445)..(445): a, c, t, g, unknown or other
  modified_base (449)..(449): a, c, t, g, unknown or other
  modified_base (451)..(451): a, c, t, g, unknown or other
  modified_base (454)..(454): a, c, t, g, unknown or other
  modified_base (456)..(456): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggaggcttggtccaggccgggggggtccctgagactctcctgtgcagtctctggatcacctagaagttatggatgctggtcgccagctcagggaagggctggagtgggtggaccaaacgaataaaacaaaagaacggaaagtacaaagaaaaaacctattagaggaactntagagacgggccaattccaccatcnccagagacaaacgaccaaagaattcatagtattgaanaaananaananacagagagagagacgacgacgtagtatattagtgcgacgagagtagagtaagtacgtaactactacgtaagtagacgtaggtaggtagtagtagtg

SEQ ID NO: 371891 - DNA, 653 bp, Homo sapiens
  misc_feature: GZ8MTXP02GR48V.15.67.G01.1.454.CMB.2.raw
tcagtctacgtagccacgaccggtgctcgatttagagtatacatattgggtttggggtctcagagaggagccttagccctggactccaaggcctttccacttggtgatcagcactgagcacagagactcaccatggagttgggctgagcgttgggttttccttgttgttatttagaaggtgtccagtgtgaggtgcacgttggtggagtcggtgggggaggtcgttgggtccgagggcccgggggggttccctggacgacctcctcctggtgccagtctcgtggtattccacccttagaagttagttggatcgaccgtggtcccgcaggcctccggaggggaggggctggaggtggggtcggaccaaataacgtaaaacgaaaggaacggaagtaccaaaggtaaaaaactgtggaggtaacctcgtaggtacgaaaccgggccctaatttaccgaaccctatccctacccgaaagaacgaaacccgaacgtacccaaaagtaacttacacttagttatttagaacaaatacgaaacagtaccagaggaggacgagggacaccggccgttagtatttatgtcgcggcgagagtgaagttaggaacgtactacgtaactagtgacgtagggttacggtatacgagttacgtttg

SEQ ID NO: 371892 - DNA, 718 bp, Homo sapiens
  misc_feature: GZ8MTXP02I1UKC.15.67.G01.1.454.CMB.2.raw
  modified_base (306)..(306): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggcccggggggtccctggagactctcctgtgcagtctctggattcacccttagaagttattggatgaccgtgggtccnccgaggcctccgaggggaagggctgggaggtggggtggacccaaacgataaaacgaaaggaccggtaaagtacaaaggaaaaaccctagtaggtcggaacttcgtaggttacgaaccggggtccgtaactttaccaaccctaacttcccgtacccaaacggaaacgaaaccaaaacccggaacccaaaacggtaaaactttcgaaacctttgtttaactttacggaactaaaagtagtaaaccgacgtacctaggaacggaggggaccggaagggaacccgacggggacccggttaggttaagtttagttaggttcggtccggacgggtagtagttagaaacgtttaggtaacgaacttccgtaaacgtaaggtaaggcgtaaaggggttggtaagttacggtagtttacgg

SEQ ID NO: 371893 - DNA, 545 bp, Homo sapiens
  misc_feature: GZ8MTXP02FY4I2.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagaagttattggatgacctgggtccgccaggctccaggggaaggggctggagtgggtggccaaacataaaacaaagacggaaagtacaagaaaaacctatagtaggactctagtagacgggccattcaccatctccagagacaacgccaaagaattcactgttatttgacaaaatgaaacagcctagagaggacgagaccacggcgtgtattatgtgcgcgagatgatagtacgactctacaagtagacgaggtgtatacgattg

SEQ ID NO: 371894 - DNA, 562 bp, Homo sapiens
  misc_feature: GZ8MTXP02ILI2E.15.67.G01.1.454.CMB.2.raw
  modified_base (511)..(511): a, c, t, g, unknown or other
  modified_base (516)..(516): a, c, t, g, unknown or other
  modified_base (544)..(544): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttgggtgggaggtcgtggggggaggctttggtccgacgggcccgggggggtccctggagacctctcctgtgcagtctctggattcacccttagaagttattggatgaccgtggtccgccaggcctccgaggggaagggctggagtgggtgccaaacataaacaaagacggaatacaagaaaaacctagtgtagactctgtacgacggccgaattccgacccatctaccagacgacaaacgcaaagattcactgtattgacaaatgaaacagcctagagaggcgaaggccacggcgtgtaattattgtgcgngagangtaagtgtacgacttcaacgaagtacgngtaggtggtatcgattcg

SEQ ID NO: 371895 - DNA, 562 bp, Homo sapiens
  misc_feature: GZ8MTXP02HXX2U.15.67.G01.1.454.CMB.2.raw
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattccacccttagaagttattggatgacctgggtccgccaggctccgaggggaaggggctgggaggtggggtggccaaacataaaacaaaagacggaaagtcaaagaaaaacctatgtggactctagtagacgggccattcaccatctcagacgacaacgccaaagacttcactgttatttacgactaaaatgaaactagaccgtagagagggacggaaggaccgacggccgttgtaattagttgtgcgngagatgatagtagactcgacaagtagcgtagggtgtatgtagtg

SEQ ID NO: 371896 - DNA, 592 bp, Homo sapiens
  misc_feature: GZ8MTXP02IUW52.15.67.G01.1.454.CMB.2.raw
  modified_base (371)..(371): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttatggatgacctgggtccgccaggctccgaggggagggctggagtgggtggccaacataaacaaagacggaagtacaagaaaacctntgtgactctgtagacggccgatccaccatctaccagacgacaacgaccaaagacttcacttgttatttgactaaatgaaacacgcctaggagacgggcgaaggaccacgggccgttgtaactttagttggtcggtacgacggagtacgtaggtaaagtaggtacgaccttacgtaacgaaggtaacgcggtaagggttaggtacgttacggtaagtttcgg

SEQ ID NO: 371897 - DNA, 805 bp, Homo sapiens
  misc_feature: GZ8MTXP02HJIEK.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattccacccttagaagttattggatgacctgggtccgccgaggctccgaggggaaggggctgggaggtggggtggaccaaacaataaacgaaaaggaacgggaaagtaccgaaagaaaaaccctagtagtagggaacttcgtaggtacggaccggggcccgtaagtttacccaaccctaattcccgtacccgaaggaacgaaacccaaaacccggacccaaaacggtaaacctttacccgaaacccgtttagggttaaactttttacgggaacctaaaaacgttacggaaaaccgtaccggtaccccgttagggaaagggacggggaaccgggaaacggggacccggaaccggggtccccgggttaaggtttaaagtttaaccggtttgggttacgggacccgggtacgggtaaacggttaggttacggtaaaacgtttaagggttaacggtaaccctttaaccgtttaaccggaaagggtttaacggaccggttaagggggtttacgggttaacgtttacggtaacgttttcgggg

SEQ ID NO: 371898 - DNA, 586 bp, Homo sapiens
  misc_feature: GZ8MTXP02HFZZA.15.67.G01.1.454.CMB.2.raw
  modified_base (344)..(344): a, c, t, g, unknown or other
  modified_base (559)..(559): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccgaggccggggggtccctgagactctcctgtgcagtctctggattcacccttagaagttattggatgacctgggtccgccaggctccgaggggaaggggctggagtgggtggccaaanataaaacaaagacggaagtcgaagaaaaacctagtgtaggactcgtggtagaccggggccgtaattccgacctatcctccaaggacgaacaaaccgacccaaagaacttacaacttaggtatttgacaaaagtagaaacagacctagaaggaggcggaaggacaacggccgtagtattagtgtagcgcgagatagatagtacgaacgttctaacnggtaacgcgtaggtaggtatgagtttg

SEQ ID NO: 371899 - DNA, 576 bp, Homo sapiens
  misc_feature: GZ8MTXP02GRZ8O.15.67.G01.1.454.CMB.2.raw
  modified_base (306)..(306): a, c, t, g, unknown or other
  modified_base (343)..(343): a, c, t, g, unknown or other
  modified_base (374)..(374): a, c, t, g, unknown or other
  modified_base (401)..(401): a, c, t, g, unknown or other
  modified_base (404)..(404): a, c, t, g, unknown or other
  modified_base (452)..(452): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccgaggccgggggggtccctggagactctcctgtgcagtctctggattcacccttagaagttatggatgacctgggccncaggctccgaggggagggctggagtgggtggaccaanataaaacaaagacggaatcaaagaaaacctntgtagactctgagacggccattccacntcnccaagagacaacgccaaagacttcactgttaacttgacaaatgaaacngcctaggagaggcgaaggaccacggcgtagtattagtcggtgccggagaggtatacggtaagtagtaacgacttacgaacgtaagttacggacgtaggggtaggttaactagggtaattttcgg

SEQ ID NO: 371900 - DNA, 593 bp, Homo sapiens
  misc_feature: GZ8MTXP02H1SRG.15.67.G01.1.454.CMB.2.raw
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggattcacccttagaagttatggatgaccgtgggtcccgccgaggctccgaggggagggctgggaggtggggtcggaccaaacgaataaaacgaaaagacggaaagtcaaagaaaaacctagtagtggactcgtgtacgacggcgtaattccacctatctaccagacgacaacgaccaaagaattcacttgtactttgaacctaaataggaaacacgacctggaaggagggacgaggaccgacgggaccgttgtaatttagttgngccggacgagattagagttaagtagtactactagaaggtgacaggggtagtatgtaagttg

SEQ ID NO: 371901 - DNA, 558 bp, Homo sapiens
  misc_feature: GZ8MTXP02GMFTA.15.67.G01.1.454.CMB.2.raw
  modified_base (305)..(305): a, c, t, g, unknown or other
  modified_base (505)..(505): a, c, t, g, unknown or other
  modified_base (508)..(508): a, c, t, g, unknown or other
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctggagactctcctgtgcagtctctggattcacccttagaagttattggatgacctgggtccnccaggctccgaggggaaggggctggaggtggggtgaccaaacgataaaaccgaaaggaacgggaagtacaaagaaaaacctatggtaggactcgtgtagaccggccgattcaccgatcaccagagacaacgaccaagaactcactgtattgactaaatagaacagcctagagaggacgaggacacggcgtagtatatgancgngtagntagatagtacgactactacgaagtagcgtaggtggtatggacttg

SEQ ID NO: 371902 - DNA, 696 bp, Homo sapiens
  misc_feature: GZ8MTXP02GOPNI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggtcgttggtccgagggcccgggggggtccctggagactctcctgtgcagtctctggattcacccttagaagttattggatgacctggtccgccaggctccgaggggagggctggagtgggtgaccaacataaacgaaaggacggaagtacaagaaaaaccctgtagtgactcgtgtacgaccggcctattcacctatctaccgagtacgacctaaacgcctaaagacttcacttggttaatttacggaactaaaagttcgaaaacacggtcccgtaggaacggacgggtaccgggacggtaacccgaccgggggtacccgttaggttaaacgtttcgttaggggtacggtaccggtaccggtaaggtacgttagggtaaacgttaacggttaaccggacccgtttacgttaaacccggtaaggttacggtaccggttaacggggtttaggtaaccgttaggttacgtttaccggg

SEQ ID NO: 371903 - DNA, 568 bp, Homo sapiens
  misc_feature: GZ8MTXP02I905O.15.67.G01.1.454.CMB.2.raw
  modified_base (479)..(479): a, c, t, g, unknown or other
  modified_base (542)..(542): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagttattggatgacctgggtccgccaggctccgaggggaaggggctgggagtggggtggaccaaacataaaacgaaaagacggaaagtacaagaaaaaacctatggtaggaactctaggtcgaaccgggccgaattcaccctatctccaagagaacaaccgacaaagaattcgacttgtatttgacaaatgaaacngcctagagaggcgaaggacacggccgtgtattatgtgcgagagatgattagtacgactactanaagtgacgtagggtgtatggatttag

SEQ ID NO: 371904 - DNA, 562 bp, Homo sapiens
  misc_feature: GZ8MTXP02ID1LN.15.67.G01.1.454.CMB.2.raw
  modified_base (345)..(345): a, c, t, g, unknown or other
  modified_base (419)..(419): a, c, t, g, unknown or other
  modified_base (462)..(462): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaggggctgggaggtggggtggccaanaataaaacaaagacggaagtcaagaaaaacctatagtggactctggtgacggccgattccaccatctaccaganacaaacgaccaaagattacactagtatttgactaaatgaaacngacctgaggaggcgagacgacggacgtgtattagtgtgcgcgagatgaagtagtacgacttaacacgaagttagcgtagggtaggttactagagtttcgg

SEQ ID NO: 371905 - DNA, 567 bp, Homo sapiens
  misc_feature: GZ8MTXP02G3KX2.15.67.G01.1.454.CMB.2.raw
  modified_base (424)..(424): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgaccgtgggtccgccgaggctccgaggggaaggggctgggaggtgggtggccaaacaataaaacaaagaacggaagtacaagaaaaacctatgtaggactcgtgtagacggccgattcaccatctaccaganacaaacgccaaagatcactgtatttagacaaatagaaacacgacctagagaggacggaaggacgacggccgtagtattagtagtgcgtacgagatgaatacggtagacctctaacgaagtagacgagggtagtatggatttgg

SEQ ID NO: 371906 - DNA, 648 bp, Homo sapiens
  misc_feature: GZ8MTXP02GRTUW.15.67.G01.1.454.CMB.2.raw
  modified_base (377)..(377): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtcagtgtgaggtgcacttggtggagtcgtgggggagcttggtccaggccggggggtcctgagactctcctgtgcagtctctggattcacccttagaagttattggatgacctgggtcccgccaggcctccgaggggaaggggctgggagtggggtggccaaagataaaacaaagacggaagcaaagaaaaacctntgtaggactcgtgtagacgggccaattccaaccgtatctccaagacgacaaaccgcaaagaacttcactgttaactttagaactaaaagtcgaaaactacgaccgttaggaagacgggacgggaacgaaccgaaccggggtacccgttagttaacgtttaagtttcggtacggcgtacggaaggtattaggaagttaaaggtacgtaaacttcccgttaaacgaacggttaagaccggtaaaggggttggttaacgtaggttaagtttagg

SEQ ID NO: 371907 - DNA, 549 bp, Homo sapiens
  misc_feature: GZ8MTXP02G4QZW.15.67.G01.1.454.CMB.2.raw
  modified_base (458)..(458): a, c, t, g, unknown or other
  modified_base (494)..(494): a, c, t, g, unknown or other
  modified_base (506)..(506): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagactctcctgtgcagtctctggattcacccttagaagttattggatgacctgggtccgcaggctccgaggggagggctggagtgggtggccaacaataaaacgaaagacggaaatacaaagaaaaacctatgtagactctgtgacgggccattccaccatctaccagacgacaacggcaaagaattcacttgtattgacaaactgaaacngtccagagaggcggagacacggcgtagtattgttgngcgagagatganaagtagacctcgtaacaagtagacgtaggtgtaagtgatttgg

SEQ ID NO: 371908 - DNA, 566 bp, Homo sapiens
  misc_feature: GZ8MTXP02HJH5K.15.67.G01.1.454.CMB.2.raw
  modified_base (504)..(504): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggagcttggtccgaggccggggggtcctggagctctcctgtgcagtctctggattcacccttagaagttattggatgacctgggtccgccaggcctccgaggggaaggggctggaggtgggtggccaaacaataaaacaaaggaaccggaaagtacaaagaaaaacctatgtaggactctgtacgacgggcctattccaccatcaccagagacaaccgaccaagaattcactgtatttgacaaatgaaacagcctagagagacggagacgacggcgtagtattagtgtgngtacgagatgaagtaagacgtaactactaactaaggtagacgtagggtggtactgtagtttg

SEQ ID NO: 371909 - DNA, 567 bp, Homo sapiens
  misc_feature: GZ8MTXP02H00LR.15.67.G01.1.454.CMB.2.raw
  modified_base (346)..(346): a, c, t, g, unknown or other
  modified_base (408)..(408): a, c, t, g, unknown or other
  modified_base (411)..(411): a, c, t, g, unknown or other
  modified_base (462)..(462): a, c, t, g, unknown or other
  modified_base (505)..(505): a, c, t, g, unknown or other
tcagtctacgtagccacgaccggtgctcgatttagagtatacatattgggtttgaggtctcagagaggagcccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggagactctcctgtgcagtctctggattcacccttagaagttatggatgacctggtccgccaggctccgaggggagggctgggagtgggtggccaaaanataaaacaaagacggaaagtacaaagaaaacctatgtgactctaggtgacggcattccaccntcnccagacgacaacgacaaagaattcacttgttatttagactaaaatcgaaanagacctaggagaggccggaaggacgacggcgtgtaatttagtntggacgcgagtatagataaaggtacaccgttcaacaagtacgagtaggtggtaatgagttcg

SEQ ID NO: 371910 - DNA, 549 bp, Homo sapiens
  misc_feature: GZ8MTXP02IUZ75.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttattggatgacctgggtccgccaggctccaggggaaggggctgggagtggggtggccaacataaacaaagacggaagtacaagaaaaacctatgtaggactctgtgacgggccgattccaccatctacagagacaacgcaaagattcactgtatttgacaaatgaaacagcctagagaggcgaggacgacggcgtgtattagtgtagcgcgagagtagagtagtagtactactacgaagtagcgtaggtgtatggtactttgg

SEQ ID NO: 371911 - DNA, 576 bp, Homo sapiens
  misc_feature: GZ8MTXP02HJ66I.15.67.G01.1.454.CMB.2.raw
  modified_base (548)..(548): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcgttggtccgaggcccgggggggtccctgagactctcctgtgcagtctctggattcacccttagaagttattggatgacctggtccgcaggctccgaggggagggctggaggtgggtggccaacataaaacaaagacggaaagtacaaagaaaaacctagtagtaggactcgtagtagaccgggccgtaattccaccatctaccagacgaacaaacgaccaaagaattcacttgtatttgacaaatagaaacagcctagagacgggagaggacgacggaccgtagtaagttattggtagcggacgagagtgaatagtacgacttacaanaagtagagtaggtaggtatacgtattcg

SEQ ID NO: 371912 - DNA, 754 bp, Homo sapiens
  misc_feature: GZ8MTXP02JWMRJ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcgttggtccgagggcccgggggggtccctggagactctcctgtgcagtctcgtggattcacccttagaagttattggatgacctgggtccgccaggctccgaggggaaggggcgtggaggtgggtggaccaaacaataaaacaaaagacggaaagtacaaagaaaaaacctagtaggtaggaaccttcgtaggttacggaaccggggtcccggtaaatttcccaaaccctattcccgtacccgaagggaaacgaacccaaaacccggacccaaaaggtaaactttaccgaacctttaggttaatttttacggacctaaaaatacggtaaaaccaaggaccccgttaggaacgggaacgggacgggaaacggggaacccgaaccgggggtccccggttaagggtttaacgtttaagtttgggttacggacccgggtacggtaaggtaggtacggtaaagttaaggtaacgtaaccttaccgtaaaccgaagggttaacgacggtagggggttaggtacgttaggtaacgtttcggg

SEQ ID NO: 371913 - DNA, 549 bp, Homo sapiens
  misc_feature: GZ8MTXP02GR7Z6.15.67.G01.1.454.CMB.2.raw
  modified_base (407)..(407): a, c, t, g, unknown or other
  modified_base (505)..(505): a, c, t, g, unknown or other
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccaggcccgggggggtccctggagactctcctgtgcagtctctggattcacccttagagttattggatgacctgggtccgccaggctccgaggggaagggctggagtgggtggcaacataaacaaagacgaagtacaagaaaaacctatgtggactctagtggaccggccattccaccanctccagagacaaccgcaaagattcactgtatttcgactaaatcgaaacagcctagagaggcgaaggacgacggccgtagtacttagtgtgcgtcgagntagataggtacactgtaacaagtacgntagggtgaatgaattgg

SEQ ID NO: 371914 - DNA, 594 bp, Homo sapiens
  misc_feature: GZ8MTXP02J3BRB.15.67.G01.1.454.CMB.2.raw
  modified_base (265)..(265): a, c, t, g, unknown or other
  modified_base (335)..(335): a, c, t, g, unknown or other
  modified_base (453)..(453): a, c, t, g, unknown or other
  modified_base (467)..(467): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaaggtgtccagtgtgaggtgcacttggtggagtctgggggagcttggtccaggccggggggtcctgagactctcctgtgcagtctctggnttcacccttagaagttattggatgacctgggtccgcagctccgaggggagggctggagtggtcgccaaanataaacgaaagacggaagtacaaagtaaaaccctgtagtacggaacttcgaggttacgaccgggcaaacttccaccagtcctaccgagaacgaacgaacgtaccaaagtaatccagtnttattgaactaaanacgaacgcgacgaggacgacggacggacgaccgtaccggtacgtagttacgttagtgacgacgtacgagatacgtagtacgtacgactacgtacgaagtacgacgtacggtagtacgtacgtagtcg

SEQ ID NO: 371915 - DNA, 576 bp, Homo sapiens
  misc_feature: GZ8MTXP02JN0YP.15.67.G01.1.454.CMB.2.raw
  modified_base (325)..(325): a, c, t, g, unknown or other
  modified_base (343)..(343): a, c, t, g, unknown or other
  modified_base (380)..(380): a, c, t, g, unknown or other
  modified_base (391)..(391): a, c, t, g, unknown or other
  modified_base (445)..(445): a, c, t, g, unknown or other
  modified_base (459)..(459): a, c, t, g, unknown or other
  modified_base (462)..(462): a, c, t, g, unknown or other
  modified_base (464)..(464): a, c, t, g, unknown or other
  modified_base (467)..(467): a, c, t, g, unknown or other
tcagtctacgtagccacgaccggtgctcgatttagagtatacatattgggtttgaggtctcagagaggagccttagccctggactccaaggcctttccacttggtgatcagcactcgagcacagaggactcaccatggagttggggctgagctgggttttccttgttgttattttagaaggtgtccagtgtgaggtgcacttggtggagtcgtgggggaggcttgggtccaggccggggggggtccctggagactctcctgtgcagtctctggattcacccttagagttattggatgacctgggtccgcaggctcagggaagggntggagtgggtggccaaanataaaacaaaagacggaaagtacaagaaaaaacctanagtggaacctntagtagacgggccgaatttcaaccaatcaccagagacaaacgaccaaagaattnactgtatttagaanaananaanagacagagagaggagacgacggacgtagtattatgtgacgacgagagtagtaagtaagtacgtaactactaacgtaaggtaaggtacgtacggtaggtagtagtagtag

SEQ ID NO: 371916 - DNA, 699 bp, Homo sapiens
  misc_feature: GZ8MTXP02GVQE3.15.67.G01.1.454.CMB.2.raw
  modified_base (686)..(686): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggtcgttggtccgagggcccgggggggtccctggacgacttctcctgtgcagtctctggattcaccttagaattatggatgaccgtggtccgcgaggcctccgaggggaacgggcgtgggaggtggggtacggaccaaaacgtaaacgtaaaaacgaaaaggtaaacgggaaagtaccgaaaagaaaaaacccgtagtaggtacggtacgttacgtaggtacgggaaccgggtcccgtaatttcccaacccgtactacctaccgaagaaacgaccaaaccggaccaaaagtacttacgacgttagttagtttacaactaaaatacgaaacacgaccgtaaggaaggacgggacggaacgggaccgtaaccggggtaccgttagtaactttaagttggtcgtaccggacgaagtagtagtaaagtaacgtacgacttacgtaacgaagtaacgacgtaggtaggttanacggttagtttcg

SEQ ID NO: 371917 - DNA, 524 bp, Homo sapiens
  misc_feature: GZ8MTXP02I4F9N.15.67.G01.1.454.CMB.2.raw
  modified_base (379)..(379): a, c, t, g, unknown or other
  modified_base (398)..(398): a, c, t, g, unknown or other
  modified_base (404)..(404): a, c, t, g, unknown or other
  modified_base (473)..(473): a, c, t, g, unknown or other
  modified_base (483)..(483): a, c, t, g, unknown or other
  modified_base (509)..(509): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctggagactctcctgtgcagtctctggattcaccttagagttattgatgactggtccgccagctcgagggagggctggagtgggtgccaaacataaaacgaaagaacggaagtacaagaaaactatgtagactcngtagacgcgatcaccatcnccaganacaacgcaagatcatgtattgacaatgaacagcctagagaggacgagacgacggccgtagtatagttgngcgacgaganaggatagtacgacgtcactaaggagngaggtgtatgacttg

SEQ ID NO: 371918 - DNA, 736 bp, Homo sapiens
  misc_feature: GZ8MTXP02JX1NY.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccggggggtcctcgagactctcctgtgcagtctctgattctacctacgtaagttattggagtgaccgtcgggtccgccgacggcgtccgaggggaaggggcggtggaggtggggtggaccgaaacaataaaacgaaaaggaaacggaaacgtaacgaaacgaaaaaccgtaagtagtaggtaactcgtaggtacgaccgggaccgtacttaccgaccactacctaccgacgaaacggaaacccaaacccggaaccgtaaaacgtaaaatttccctaacgttagtttaacgtttaacgaaccaaaaagtttacggaaaaccgacgtacccgtaggggaaggaaacggggaccggggaaagggaacccgtaacccgggggtccggtttaggtttaaagttttagtttaggcgggaacccggcgggtaaaaggtagttacgtaaagtagtaacgtaccttaacgtacgaaggtaggcgtaaggggttggtaattacggtatttcgg

SEQ ID NO: 371919 - DNA, 567 bp, Homo sapiens
  misc_feature: GZ8MTXP02JDK9P.15.67.G01.1.454.CMB.2.raw
  modified_base (312)..(312): a, c, t, g, unknown or other
  modified_base (347)..(347): a, c, t, g, unknown or other
  modified_base (541)..(541): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttgggtggagtcgtggggggaggcttggtccgagggcccgggggggtccctggagactctcctgtgcagtctctggattcacccttagaagttattggatgacctgggtccncagctccgaggggagggctggagtgggtgccaaanataaacaaaggacggaagtacaagaaaaacctagtagtcgactctgtagaccgggccgtattccaccatctaccagaacgaccaaacgaccaaagaattcacttgtatttgactaaaatgaaacagcctagaggaggacggagtacgacggacgtgtattagtgtgcgtacgagtatagatacgtagactacanaagtacgagtaggtagtatggattag

SEQ ID NO: 371920 - DNA, 585 bp, Homo sapiens
  misc_feature: GZ8MTXP02JKR24.15.67.G01.1.454.CMB.2.raw
  modified_base (469)..(469): a, c, t, g, unknown or other
  modified_base (475)..(475): a, c, t, g, unknown or other
  modified_base (522)..(522): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagctctcctgtgcagtctctggatcacccttagagttatggatgacctggtccgcaggctccgaggggaaggggctggaggtgggtggaccaaacataaacaaaggacggaagtacaagaaaaacctagtgtaggacttcgtagtaggaccgggccgaagttccaaccctagttccacccgaagaacgaccaaacgaccaaagaattacactagtatttganaagtanaaacagacctagagaggacggaggacgaccggcgtgtattagttagngacgcgtagatagagttagtacgactacgtacgaagtacgacgtagggtagtagtgaacttgg

SEQ ID NO: 371921 - DNA, 555 bp, Homo sapiens
  misc_feature: GZ8MTXP02F7243.15.67.G01.1.454.CMB.2.raw
  modified_base (463)..(463): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccggggggtccctgagactctcctgtgcagtctctggattcacccttagaagttattggatgacctgggtccgccaggctccaggggaagggcgtggaggtgggtggccaaacataaacgaaagacggaagtacaagaaaaacctagtagtggaacttcgtgtgaccgggccgtattacacccatctaccagagacaaacgcaagaacttcactgtatttagcaaatgaaacngcctgagaggacgagacgacggcgtgttatagttgtgcgacgagatagatagtacgactctacaagtacgacgtaggtaggtagtagatttg

SEQ ID NO: 371922 - DNA, 602 bp, Homo sapiens
  misc_feature: GZ8MTXP02IMX87.15.67.G01.1.454.CMB.2.raw
  modified_base (298)..(298): a, c, t, g, unknown or other
  modified_base (374)..(374): a, c, t, g, unknown or other
  modified_base (377)..(377): a, c, t, g, unknown or other
  modified_base (382)..(382): a, c, t, g, unknown or other
  modified_base (543)..(543): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgatctgggttttccttgttgttatttagaaggtgtccagtgtgaggtgcacttgggtggagtcgtgggggagcttggtccaggccggggggtcctgagctctctgtgcagtctctggattcacccttagaagttatggatgacctgggtccnccaggctccgaggggaaggggcgtgggaggtgggtgaccaaacaagtaaaacaaagacggagtacaagaaaacctntgngactntgtcgacggcgtattaccacctagtcaccaagacgacaacgaccaaagtattcaacttgttaatttcgaaactaaagtagaaaccacggtacctagggaggacgggcggaacgggacccgacgggtaccgttagttaatttagttggtcggacgtacgagngtaggtataggtacgacttactacgtaagtacgacgtagggtagtacgtagtagtttgg

SEQ ID NO: 371923 - DNA, 623 bp, Homo sapiens
  misc_feature: GZ8MTXP02GUTP4.15.67.G01.1.454.CMB.2.raw
  modified_base (589)..(589): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccgagggccggggggtccctggagactctcctgtgcagtctctggacttcacccttagaagttatgggatgacctgggtccgccaggctccgaggggaagggctggaggtgggtggaccaacaataaacgaaagacggaagtcaaagaaaaacctgtagtggaactctaggtacgaccggggcctagttacccaccatccgtaccaaggaacgaacaaacccgacctaaagaacttccaacttggttaactttaggacctaaaagtagaaaaccgacgacctaggaacggagggacgggaaggacccgaacggtccggttagttaattagttgcgcgtcgaggtatagagttaagtacgaactntaacgaagtagacgtaggtaggtaatggtattcg

SEQ ID NO: 371924 - DNA, 549 bp, Homo sapiens
  misc_feature: GZ8MTXP02GXNCX.15.67.G01.1.454.CMB.2.raw
  modified_base (449)..(449): a, c, t, g, unknown or other
  modified_base (491)..(491): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggattccacccttagaagttattggatgaccgtgggtccgccaggcctccgaggggaggggctggaggtgggtgccaacataaacgaaagacggaagtacaagaaaacctatgtagactctgtgaccggcgattcaccatctccagacgacaacgacaagaatcactgtattgacaatnaaacagcctgagaggcggagacgacggcgtagtacttagtgngtcgcgagatgatagtacgaacctcgtacaaggtagagtagggtggtatacgatttgg

SEQ ID NO: 371925 - DNA, 635 bp, Homo sapiens
  misc_feature: GZ8MTXP02H2Z3D.15.67.G01.1.454.CMB.2.raw
  modified_base (263)..(263): a, c, t, g, unknown or other
  modified_base (403)..(403): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggtcgttggtccgagggcccggggggtcctgagactctcctgtgcngtctctggacttcaccttagaagttattggatgaccgtgggtcccgccgaggcctaccgaggggaaggggcgtgggaggtggggtacggacccaaaagaaagtaaaacgaaacgaacggaaagtacaaagtaaaaacctntaggtaggactcgtggtacgaccgggcctattccacctatcctaccagacaacaaaccgaccaaagtaactactacttgttatttagaaactaaatacgaaactacgaccgtaggagaacgggcggaacggaccgacggacgttagtatttagtgtacgcgtacggagtatagtaaagtacgtaacgacttacgacgtaagtacgtacggtaggttggtagtgtaacgtttg

SEQ ID NO: 371926 - DNA, 609 bp, Homo sapiens
  misc_feature: GZ8MTXP02GWW7L.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccgaggcccggggggtcctgagacctctcctgtgcagtctcgtggattccacccttagtaagttattggatgaccgtgggtcccgccgaggctccgaaggggaggggctgggagtgggtgaccaacaataaacaaagacggaatacaaagaaaaacctagtgtaggactctgtagaccgggccattccacctaatctaccagacgaacaacgaccaaagaatacactagttatttagaactaaagtacgaaacacgaccgtagaggacggacggaaggaccgacgggtcctagtacttagtgtgacgacgagtagtagtagtaagtaacgtactaccgttaaacaaggtaacgacggtagggttagtacgtagtacgtttgg

SEQ ID NO: 371927 - DNA, 534 bp, Homo sapiens
  misc_feature: GZ8MTXP02IWO92.15.67.G01.1.454.CMB.2.raw
  modified_base (375)..(375): a, c, t, g, unknown or other
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctgggtccgccaggctccgaggggaaggggctggagtgggtggccaacataaacaaagacggaagtacaagaaaaacctntagtggactctgtgacggcatcaccatctcagagacaacgcaaagaattcactgtatttgacaaatgaaacagcctagagagggcgaggacgacggcgtgtattagttgtagcgtacgagatgatagtacgactctanaagtagcgaggtgtatgattg

SEQ ID NO: 371928 - DNA, 556 bp, Homo sapiens
  misc_feature: GZ8MTXP02GF78H.15.67.G01.1.454.CMB.2.raw
  modified_base (428)..(428): a, c, t, g, unknown or other
  modified_base (449)..(449): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggaggtggggtcggaccaaacataaaacgaaaagaacggaaagtacaagaaaaacctatagtgactcgtagtagacggccgattcaccatctaccaganacaacgaccaaagaatcactntaatttgacaaaatgaaacagccgtagagaggagagacgacggcgtagtattatgtagcgacgagatgatagtagactctaacaagtagcgtaggtggtatcgattg

SEQ ID NO: 371929 - DNA, 569 bp, Homo sapiens
  misc_feature: GZ8MTXP02FMHRY.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgagggccgggggggtccctgagactctcctgtgcagtctctggattcacccttagagttatggatgacctggtccgccaggctccgaggggagggctggaggtgggtggaccaaacataaaacgaaagaacggaagtacaagaaaaacctatgaggactctgtacgacggccgattccaccatctccaagacgacaaacgaccaaagaattcactgttatttgactaaaatgaaacacgacctagaagagtacggaggaccacgggtcgtagtatttagtggtgcggacgagatagatagtacgactctaacgaagtacgacgtaggtaggtatggatttg

SEQ ID NO: 371930 - DNA, 569 bp, Homo sapiens
  misc_feature: GZ8MTXP02F9JXZ.15.67.G01.1.454.CMB.2.raw
  modified_base (204)..(204): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggnggagtcgtgggggaggcttggtccaggccggggggtccctgagactctcctgtgcagtctcgtggattcaccccttagaagttattggatgaccgtgggtccgccaggctccgagggaagggcgtggagtgggtggccaaaacataaaacaaaagaacggaaagtacaaagaaaaaacctatagtaggactcgtgtagacggcgattcaccatctaccagaacgacaaaccgccaaaagaattacactgtattgacaaaatgaaacagcctagagaggacgaggaacacggccgtgtattatgtgcgtcgagatagagtaagtacgaactcgtaaacaagtaacgcgaaggttgactagatttag

SEQ ID NO: 371931 - DNA, 756 bp, Homo sapiens
  misc_feature: GZ8MTXP02ISWFT.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggattcacccttagagttattggatgacctgggtccgccaggcctccgaggggaggggctgggagtggggtggccaaacgataaacaaaaggacggaaagtacaagtaaaaacctagtagtggaaccttcgtaggtacggaccggggtccgtaactttccaacccctacttcccgtacccgaaaggaacggaaacccaaaaccggacccctaaaaaggtaaactttacctaaccgtttaggtttaaacgtttttaacggaaccttaaaaacgtacggtaaaaccgaaacgtaccccgttaaggaaaggggacgggaccggggaaaccgggaaccggaccgggtacccggttaggtttaaagtttacgtttggtacgggtcggaaccggtaggaagtttacggaaagttagggtaacgttaaccgttaccttaaaccgtaaggttaaggaccggtaagggggtttaggttacgttacggtaagttttcgg

SEQ ID NO: 371932 - DNA, 583 bp, Homo sapiens
  misc_feature: GZ8MTXP02IHO9X.15.67.G01.1.454.CMB.2.raw
  modified_base (375)..(375): a, c, t, g, unknown or other
  modified_base (463)..(463): a, c, t, g, unknown or other
  modified_base (468)..(468): a, c, t, g, unknown or other
  modified_base (480)..(480): a, c, t, g, unknown or other
  modified_base (547)..(547): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccgaggcccgggggggtccctggagactctcctgtgcagtctctggattcacccttagagttatggatggctggtccgccaggctccgaggggaagggctggagtgggtcgcaaacataaaacaaaggacggaagtcaaagaaaaccctntagtaggactcgtggtgaccgggccgattaccacctatctaccagaacgacaaaccgacccaaagacttcactagtattgacaaagtnaaacngactagagaggngaaggcgaggtaccgtagtattagtgtgacgcgagataggaactaggtaactacctaccgttaacgngtaaaggtcgtagggttaggtataggaacgttttgg

SEQ ID NO: 371933 - DNA, 546 bp, Homo sapiens
  misc_feature: GZ8MTXP02G382D.15.67.G01.1.454.CMB.2.raw
  modified_base (408)..(408): a, c, t, g, unknown or other
  modified_base (523)..(523): a, c, t, g, unknown or other
  modified_base (529)..(529): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggcccgggggggtccctggagactctcctgtgcagtctctggattcaccccttagaagttattggatgacctgggtccgccaggctccgaggggaaggggctggagtgggtggccaacataaacaaagacggaagtcaagaaaaacctatgagactctgtgacggcgattcaccatcncagagacaacgaccaagaattcaactgtatttgacaaatgaaacagcctgagaggacggagacgacggccggtagtattattggtgcgtcgagtatgaatagtacgactctaacngtacgngtaggtgtatggattgg

SEQ ID NO: 371934 - DNA, 560 bp, Homo sapiens
  misc_feature: GZ8MTXP02JIAA4.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctggagtggggtggccaacataaaacaaaggacggaagtcaagaaaaacctatgtggactctgtgacggcgattcaccatctaccagacgacaaacgaccaaagaattacactgtatttgacaaatagaaacagccgtagacggaggacggaaggaccgacggaccgtgtattagttgtgcgcgagatacgatagtagactctaacgaagtagacgtaggtggtactggtattgg

SEQ ID NO: 371935 - DNA, 543 bp, Homo sapiens
  misc_feature: GZ8MTXP02HR27Q.15.67.G01.1.454.CMB.2.raw
  modified_base (301)..(301): a, c, t, g, unknown or other
  modified_base (338)..(338): a, c, t, g, unknown or other
  modified_base (470)..(470): a, c, t, g, unknown or other
  modified_base (481)..(481): a, c, t, g, unknown or other
  modified_base (490)..(490): a, c, t, g, unknown or other
  modified_base (513)..(513): a, c, t, g, unknown or other
  modified_base (535)..(535): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcttggtccaggccggggggtcctgagactctcctgtgcagtctctggattcacccttagaagttatggatgacctgggtccncaggctccgagggaagggctggagtgggtggaccaanataaaacgaaagacggaaagtcaagaaaaacctagtgtaggactctggtagacgggcgattcaccatctcagagacaacgacaagatcactgtattgacaaatgaacagctgagagcgaggacacggccgtntagttagttgngacgcgagngtacgagtagacgtactcctaanaagttagacgtaggtaggtacngtagtttg

SEQ ID NO: 371936 - DNA, 553 bp, Homo sapiens
  misc_feature: GZ8MTXP02J210R.15.67.G01.1.454.CMB.2.raw
  modified_base (303)..(303): a, c, t, g, unknown or other
  modified_base (338)..(338): a, c, t, g, unknown or other
  modified_base (364)..(364): a, c, t, g, unknown or other
  modified_base (389)..(389): a, c, t, g, unknown or other
  modified_base (413)..(413): a, c, t, g, unknown or other
  modified_base (428)..(428): a, c, t, g, unknown or other
  modified_base (432)..(432): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggagcttggtccaggccgggggggtccctgagactctcctgtgcagtctctggattcacccttagaagttattggatgacctgggtccncaggctccgaggggagggctggagtgggtgccaanataaacaagacgaatcaagaaaaccntgcgactctgtgacggcgatcacanctcagacgacacgactaagacttnactgatttgactaangacngcgagagaggacgagaccgacggtacgtagtattagtgacgcgtacgaagtagtacgtaagtacgtacgtacgtacgtaacgtaacggtacgtacggtaggttaggtacgtagtacgtacg

SEQ ID NO: 371937 - DNA, 622 bp, Homo sapiens
  misc_feature: GZ8MTXP02H7QKN.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcgttggtccgaggccggggggtcctggagactctcctgtgcagtctctggattcacccttagaagttattggatgaccgtgggtccgccaggctccgaggggaaggggcgtggaggtgggtggacccaaacaaataaaaccaaaaggaacggaaagtacaaagaaaaacctagtaggtaggactcgtaggtacggaccgggccgtaatttcccaacctataccctaccaagaacgaacccaaacggacccaaaagaacttaccaacgttagttaatttgaacctaaatcgaaacaagtccgtaggagagggacgaggacgacggcgttagtattagttgtgccggtgagtatagaataggtacgacttcaacaaggtacgacgtaggtgtagtgtaacttg

SEQ ID NO: 371938 - DNA, 670 bp, Homo sapiens
  misc_feature: GZ8MTXP02JCY20.15.67.G01.1.454.CMB.2.raw
  modified_base (406)..(406): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggtcgttggtccgagggcccggggggtccctgagactctcctgtgcagtctcgtggacttccacccttaagaagttagttggatcgaccgtgggtcccgccgaggcctaccgaggggaaggggctgggaggtggggtcgaccaaaaccgaataaaacgaaagaacggaatacgaaagaaaaaacctntggtaggacttcgtaggtacgaccgggccgtattaccacctatcctaaccgagaacgaaccgaaaccgaaccaaagtaacttactaactagttaatttcgaataaaacgtacgtaaacgacgtaccaggaagacgggacgaacgggaccgacgggtaccgtagttaagttaagtttgcgccggacgaagtagtacggtaattaaggtactaaccgtcgttaaacgaaggttacgacggtagggtagtagttagggtaactttgg

SEQ ID NO: 371939 - DNA, 618 bp, Homo sapiens
  misc_feature: GZ8MTXP02JICF3.15.67.G01.1.454.CMB.2.raw
  modified_base (310)..(310): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgagggcccgggggggtccctgagactctcctgtgcagtctctggattcacccttagaagttattggatgaccgtgggtcccnccgaggcctccgaggggaaggggcgtgggaggtggggtggaccaaacgaataaaacgaaaggacggaaagtacaaagaaaaacctagtagtaggactcgtggtacggaccggccgtaattccgaacccatctacccaagacgaacaaccgaccaaagaattacacttgtatttacgactaaatagaaacacgcctagaacggacgggacgaacgggaccgacggtccggttagtattagttgtagcgagagatagataggtagtaccgtctaacgaagtacgacgtaggtaggtataggtactttagg

SEQ ID NO: 371940 - DNA, 658 bp, Homo sapiens
  misc_feature: GZ8MTXP02ITAWC.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggacttcacccttagagttatggatgacctggtccgccaggctccgaggggagggcgtgggaggtgggtggaccaaacaataaacgaaagaccggaagtacaagaaaacctatgtaggactctaggtagaccgggcctaattaccaacctactcctaccaagacgaacaaaccgacccaaagaacttaccacttgttaatttagaactaaaactagtaaaacacggtaccctaggaacggacgggacggaacggaaccgacgggtacccgtaggttaaatttaagttggtaggaccgtacggaaggtaataggaaattaaggttacgaacgttaccgtaaaccgaaggttaacgacggtaaggggttaggtacttaggtaacgtttgg

SEQ ID NO: 371941 - DNA, 553 bp, Homo sapiens
  misc_feature: GZ8MTXP02GH0PI.15.67.G01.1.454.CMB.2.raw
  modified_base (534)..(534): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctgggtccgccaggctccgaggggaaggggctgggagtggggtggccaacataaaacgaaagacggaagtacaagaaaaacctatagtggactctgtgacggcgattcaccatctccagagacaacgccaaagaattcactgtatttgacaaactgaaacagcctagagagggacgaggaaccgacggccgtgtaacttagttagtgcgacgagatgaatagtacgactctacaagtanacgtaggtggtatgatttg

SEQ ID NO: 371942 - DNA, 668 bp, Homo sapiens
  misc_feature: GZ8MTXP02J0U6H.15.67.G01.1.454.CMB.2.raw
  modified_base (372)..(372): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcggtgggggaggcgttggtccgagggcccgggggggtccctggacgactcctccgtgtgcagtctcgtggtacttccacccttagtaagttagttggatgaccgtgggtcccgccgaggccgtaccgaggggaagggcgtggaggtggggtcggaccaaanaaataaaacgaaaggaacggaaagtacgaaaagaaaaaaccctagtagtaggactcgtaggttacggaccgggccgtaacttccaacctactcctaccgaagaacgaaccgaaaccgaacccaaagtaaacttcacgttagttaactttagaactaaaatacgaaacacgaccgtaggacggagggacgggacggaccgaccgggtaccgtagttacttagttgtcggcgacggagagtagtaagtaggtactacgtactaacgaaggttacgacgtagggtagtagtgtagtttg

SEQ ID NO: 371943 - DNA, 659 bp, Homo sapiens
  misc_feature: GZ8MTXP02JU503.15.67.G01.1.454.CMB.2.raw
  modified_base (503)..(503): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcaccttagagttattggatgacctggtccgcaggctccgaggggagggctggagtgggtcggccaaacgaataaaacaaaggaacggaaagtacgaaagaaaaaccctgtaggtagggaacttcgtaggttacgaccgggccgtaatttcccaaccgtatcctaccgaagacgaaaccgaaacgacccaaagtaacttcgacttagttaatttacgaactaaatagaaaccngacccgtaggaaggacgggacggaaggaccgaacgggtccgttaggttaatttagttggacgcggtacgaaggacttacggtaaagttaggtacgtaccgttacgtaaaccgaaggttaacgaccggtaggggttagttaagtcggaattttcggg

SEQ ID NO: 371944 - DNA, 540 bp, Homo sapiens
  misc_feature: GZ8MTXP02GGFMS.15.67.G01.1.454.CMB.2.raw
  modified_base (383)..(383): a, c, t, g, unknown or other
  modified_base (421)..(421): a, c, t, g, unknown or other
  modified_base (457)..(457): a, c, t, g, unknown or other
  modified_base (493)..(493): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagttattggatgacctggtccgccaggctccaggggaaggggctgggagtggggtggccaaacgataaaacgaaagacggaaagtacaagaaaaaacctntgtaggactctgtgacggcgattccaccatctccaganacaacgccaagaatcactgtattgacaaatgaaacngcctgagagacgagacacggcgtgtattatgtgcgngagatgatacgtagactctaacaagtagcgaggtggtaatgagttcg

SEQ ID NO: 371945 - DNA, 668 bp, Homo sapiens
  misc_feature: GZ8MTXP02GAZJ3.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgttgggttttccttgttgttattttagaaggtgtccagtgtgaggtgcacttggtggagtcgtgggggaggcgttggtccgagggcccggggggtccctggacgctctcctgtgcagtctcgtggattcacccttagaagttattggatgacctgggtccgccaggctccgaggggaagggctgggaggtggggtcggacccaaaacgaataaaacgaaaaggaccggaaagtaccgaaaggaaaaaaccctgtaggtaggaactcgtagtacggaccgggcccgattccaaccacgtctaccaagaacgaaccgaaaccgaccgaaaagtaaacttaccaacgttacgttaattttaggaacctaaaagtgaaaaccgtacgacccgttaggaaggagggacgaaacgggaccgaacgggccgttagttaagtttagttgtcggcgacggagtagtgaaagttagaacgtactacgtaacaaggtagacggtaagggttggtaagtggtactttgg

SEQ ID NO: 371946 - DNA, 558 bp, Homo sapiens
  misc_feature: GZ8MTXP02J1TP5.15.67.G01.1.454.CMB.2.raw
  modified_base (395)..(395): a, c, t, g, unknown or other
  modified_base (529)..(529): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgagggcccgggggggtccctggagactctcctgtgcagtctcgtggattcacccttagaagttattggatgacctgggtccgccaggctccgaggggaaggggctggagtggggtggccaaacataaacaaagacggaaagtcaagaaaaacctatgtggactcngtgacggcgatccacatctccagacgacaacgaccaaagattcactgtatttgacaaatgaacagcctaggagaggcgaggacacggccgtgtattagttgtgcgacgagatgtaactagtacgacctactaanaagttagacgtagggtgtagtgtatttcg

SEQ ID NO: 371947 - DNA, 565 bp, Homo sapiens
  misc_feature: GZ8MTXP02HZXKC.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtgggtggaccaacataaaacaaagacggaaagtacaagaaaaacctatagtaggactctgtagacgggccgattccaccatctccaagagacaaacgaccaagaatcgactgtatttgacaaatagaaacacgacctgagaggacggaggacacgggccgttagtattagttgagcgtacgagaatgaataacgtagactacacaagtagtacagggtagtagtgaacttgg

SEQ ID NO: 371948 - DNA, 624 bp, Homo sapiens
  misc_feature: GZ8MTXP02HS8DH.15.67.G01.1.454.CMB.2.raw
  modified_base (445)..(445): a, c, t, g, unknown or other
  modified_base (550)..(550): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgagggcccggggggtccctggagactctcctgtgcagtctctggattccacccttagaagttatggatgacctggtccgcaggctccgaggggaaggggctgggagtggggtcgggaccaaaacaataaaacgaaaaggaacgggaaagtacgaaagaaaaacctagtgtaggaactcgttgtagaaccgggccattccaacctatctcccaaganaaccaaacggtacccaaagaacttactactagttattttagactaaaatagaaacacgacctaggagaggacggaggaccgtacgggccgtagtaattattgggngcgacgagtagtacgtaagtaacgtacgtactaacgtaacgtaagtacgacggtaggtagttagtagtagttcg

SEQ ID NO: 371949 - DNA, 541 bp, Homo sapiens
  misc_feature: GZ8MTXP02JNZ2O.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagactctcctgtgcagtctctggattcacccttagagttattggatgacctgggtccgccaggctccaggggaaggggctgggagtggggtgccaacataaacaaagacggaagtcaagaaaaacctgtgtggactctgtgacggccgattcaccatctccagagacaaacgccaagaacttcactgtatttgacaaatgaaacagacctgagaggcggaggaccacggccgtgtattattgtagcgcgagatcgattagtagactctacgaagtacgcgaggtagtatgattg

SEQ ID NO: 371950 - DNA, 600 bp, Homo sapiens
  misc_feature: GZ8MTXP02I8Z20.15.67.G01.1.454.CMB.2.raw
  modified_base (386)..(386): a, c, t, g, unknown or other
  modified_base (448)..(448): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtcccgaggcccgggggggtccctggagactcctcctgtgcagtctctggattcacccttagagttattggatgacctggtccgccaggctccgagggaggggctggagtgggtggaccaaacgaataaaacgaaagacggaaagtacaagaaaaaccctntagtggaactcgtagtcgaccgggccgattccaccatctccagaagaccaaacggaaccctnaaacgtaatacacaacttagtacttagtacaaactagaacacgacgaggacggacggacgacggacgacggtcgtagtagtagtgtacgacgagtagagtacgtacgtacgtacgactaacgtacgtacgtacgtacgtacggtagtagtag

SEQ ID NO: 371951 - DNA, 562 bp, Homo sapiens
  misc_feature: GZ8MTXP02FXONX.15.67.G01.1.454.CMB.2.raw
  modified_base (508)..(508): a, c, t, g, unknown or other
  modified_base (531)..(531): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagttattggatgacctgggtccgccaggctccgaggggaaggggctggagtgggtgccaacataaacaaagacggaagtacaagaaaaaccctatagtaggactctaggtgaccgggccaattccacccactcccccaagacgacaacgaccaaagaattcactgtactttgacaaatgaacagcctgagaggacgagggacacgggccgtgtattatgtgcgngagatgatagtacgactactaanagtaagcgtaaggtggtatgagtcgtttacg

SEQ ID NO: 371952 - DNA, 591 bp, Homo sapiens
  misc_feature: GZ8MTXP02HTPTZ.15.67.G01.1.454.CMB.2.raw
  modified_base (317)..(317): a, c, t, g, unknown or other
  modified_base (355)..(355): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttgggtgggagttcgtggggggaggtcgttggtcccgagggcccgggggggtccctggagactctcctgtgcagtctctggattccacccttagaagttatggatgacctgggtccncaggctccgaggggagggctggagtgggtcggaccaanaataaaacaaagacggaaatacaaagaaaaacctagtgtaggactctggtgaccggcgtattccacctatctacagacgaacaacgacaaagacttcactagttattgacaaatgaaacagctaggagaggcgacggacgacggcgtgtattatcgtgccggacgagatagacttaaggtacgaacttacaacgtaaggttagacggttagggtaggttaattcggtaagtttcgg

SEQ ID NO: 371953 - DNA, 531 bp, Homo sapiens
  misc_feature: GZ8MTXP02G6ANH.15.67.G01.1.454.CMB.2.raw
  modified_base (271)..(271): a, c, t, g, unknown or other
  modified_base (307)..(307): a, c, t, g, unknown or other
  modified_base (348)..(348): a, c, t, g, unknown or other
  modified_base (373)..(373): a, c, t, g, unknown or other
  modified_base (391)..(391): a, c, t, g, unknown or other
  modified_base (412)..(412): a, c, t, g, unknown or other
  modified_base (415)..(415): a, c, t, g, unknown or other
  modified_base (417)..(417): a, c, t, g, unknown or other
  modified_base (433)..(433): a, c, t, g, unknown or other
  modified_base (457)..(457): a, c, t, g, unknown or other
  modified_base (471)..(471): a, c, t, g, unknown or other
  modified_base (487)..(487): a, c, t, g, unknown or other
  modified_base (505)..(505): a, c, t, g, unknown or other
  modified_base (527)..(527): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacgttggtggagtcgtgggggaggtcttggtccgaggccgggggggtccctggagactctcctgtgcagtctntggattcacctagaagttatggatgacctgggtccnccaggctccgaggggaagggctgggagtgggtggaccaaanaataaacgaaagacggaatacaaanaaaacctgtgtagacctntgagtacggcatcaccatccncananacacacaagaatcatntattgacaatgaacagctgagagngagacgacgacgtntatatgtgcgcgagangaactagtagactcgaanaagtacgagtaggtagtagtgnttcg

SEQ ID NO: 371954 - DNA, 604 bp, Homo sapiens
  misc_feature: GZ8MTXP02I6MPU.15.67.G01.1.454.CMB.2.raw
  modified_base (338)..(338): a, c, t, g, unknown or other
  modified_base (345)..(345): a, c, t, g, unknown or other
  modified_base (377)..(377): a, c, t, g, unknown or other
  modified_base (407)..(407): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgcacttggtggagtcgtgggggaggtcttggtccgagggccggggggtccctggagactctcctgtgcagtctctggattcaccttagaagttattggatgacctggtccgccaggctccgaggggagggctggagtgggngccaaanataaaacaaagacgaatacaaagaaaaacctntagagactcgtgtacgacggcctatccacntcctaccagaagaccaaacgacaaagaacttacactgttaatttagacaaatacgaaacagacctagagacgggacggaacgaccgacggtccgtagttacgttagttgtcgcgtacggagtagtaggtaattaaggtacgtaccgtaaccgtaagtaacggtaagtacgtagggttaggtagttacgaagtttcgg

SEQ ID NO: 371955 - DNA, 627 bp, Homo sapiens
  misc_feature: GZ8MTXP02IR7KB.15.67.G01.1.454.CMB.2.raw
  modified_base (371)..(371): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggcccgggggggtccctgagactctcctgtgcagtctctggattcacccttagaagttattggatgaccgtcgggtccgccaggcctccgaggggaaggggctggaggtggggtgccaaacaataaaacaaagacggaagtanaagaaaaacctatagtggactcgtggtacgacgggccgtattaccgaccctactctaccgaagagaaccaacgaccaaagtaacttacacgttgttaatttgaacaaaagtagaaactagacccgtaggaagacgggacggaacggaccgacggtaccgttgtaaatttagttggtgcgacggaagtagtgaaagtacggtaagaccttacgttaacgaaggttacggacgtaagggttggtaagtggtactttgg

SEQ ID NO: 371956 - DNA, 618 bp, Homo sapiens
  misc_feature: GZ8MTXP02IQXPQ.15.67.G01.1.454.CMB.2.raw
  modified_base (505)..(505): a, c, t, g, unknown or other
  modified_base (546)..(546): a, c, t, g, unknown or other
  modified_base (555)..(555): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcgttggtccgaggccggggggtccctggagactctcctgtgcagtctcgtggattcacccttagagttattggatgaccgtgggtccgccaggctccgaggggaagggcgtgggaggtggggtcggaccaaacaataaaacgaaaggaacgaaagtacaaagaaaaacctagtagtcggactcgtagtacgaccggggcctaattccgaacctacttacaccaagaaacgaaccaaacggacccaaaggtaaattccacttagttaatttgaactaaatagaaacngacctagagaggcgaaggacgacggccgtagtagttattgngccgtacgntagtacgaagttagtaacgacttacctagaagttagacgtagggttagtacctagtactttgg

SEQ ID NO: 371957 - DNA, 670 bp, Homo sapiens
  misc_feature: GZ8MTXP02G2FNO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcacatggagttgggctgagctgggttttccttgttgttattttagaaggtgtccagtgtgaggtgcacgttggtggagtcgtgggggaggcttggtccgagggccggggggtccctggagactctcctgtgcagtctcgtggattcacccttagaagttatggatgacctgggtccgccaggctccgaggggaaggggctgggaggtgggtcggaccaaacaataaaaacgaaaaggaaccgggaaagtaccgaaagaaaaaacccgtattagtaggacttctaggtacgaaccgggccgaatttccaaccctatcctacccaagaacgaaaccaaaccgaccaaaagtaaacttaccgtaactgttaactttagaactaaaatagaaaacacggacctaggaaggaacgggaccggaaggaaccgaccggccgttagtaattagttgtgccgtacggaagtagtaggaaattaaggtaacgaccgttacgtaaaccgtaagttaacggaccgtaaggggttagggtataggtactttagg

SEQ ID NO: 371958 - DNA, 626 bp, Homo sapiens
  misc_feature: GZ8MTXP02H5AM6.15.67.G01.1.454.CMB.2.raw
  modified_base (346)..(346): a, c, t, g, unknown or other
  modified_base (378)..(378): a, c, t, g, unknown or other
  modified_base (535)..(535): a, c, t, g, unknown or other
tcagtctacgtagccacgaccggtgctcgatttagagtatacatattgggtttggggtctcagagaggagccttagcccctggactccaaggcctttccacttggtgatcagcactgagcacagaggactcaccatggagttggggctgagctgggttttccttgttgttattttagaaggtgtccagtgtgaggtgcacttggtggagtcgtgggggagcgttggtccgaggccgggggggtccctggagactctcctgtgcagtctctggattcacccttagaagttatggatgacctgggtccgccaggctccgagggaaggggctggagtggggtgaccaanataaacgaaagacggaatcgaaagaaaaactntagtgactcgtgtagaacgccgattcaccatctcagagacaacgaccaagaaacttcattagttactttagacaaaatgaaaactacggaccttaggaacgggaggaccgggaaagggaccaaccggggcccgttaggttaattaacgttttcgggngacggtacgtaagtagtacgtaaagttaacgtaacgtacctacgtaacgaggtaacgacgtaaggggtacgtagtacgtagttacgttacg

SEQ ID NO: 371959 - DNA, 681 bp, Homo sapiens
  misc_feature: GZ8MTXP02IQY34.15.67.G01.1.454.CMB.2.raw
  modified_base (306)..(306): a, c, t, g, unknown or other
  modified_base (375)..(375): a, c, t, g, unknown or other
  modified_base (568)..(568): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtgggggaggcttggtccgaggcccggggggtccctgagactctcctgtgcagtctctggattcacccttagagttattggatgacctgggtccnccaggctccgaggggagggctggagtgggtggccaaacataaacaaagacgaagtacaagaaaaacctntgtacggactcgtaggtagaccgggccgattccgacctaatcctccaagacgaacaaaccgaccaaaagaactttaccaacttgttaacttttagaacctaaaagtcggaaaacctacggtccctagggaacggacgggacgggaaacggaacccgacggggtacccgttaggtttaaacttagtttacgggngaccggtacggaaaggtagtacggtaaaagtaggttaacgtaacccgttacttaaaaccgaagggttaaaacgccggtaaggggttaaggttacgttacggtaacgttttcgg

SEQ ID NO: 371960 - DNA, 586 bp, Homo sapiens
  misc_feature: GZ8MTXP02I9GWZ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgagggcccgggggggtccctggagactctcctgtgcagtctctggattcacccttagaagttatggatgacctgggtccgccaggctccgaggggaagggcgtggaggtggggtggaccaaaacaactaaaacgaaaaggaacggaagtacaaaggaaaaacctagtagtaggactctaggtacgaaccggggcctaattccaacctatcctccaagagacaaacgaccaagaattacgactgtatttgacaaatgaaacagcctagagaggcgagacgacggcgtgtacttagtagtgcgtcgagatagattagtacgactctaacgaaggtacgacgtaggtgtatgtaagttgg

SEQ ID NO: 371961 - DNA, 534 bp, Homo sapiens
  misc_feature: GZ8MTXP02HJT77.15.67.G01.1.454.CMB.2.raw
  modified_base (527)..(527): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagaagttatggatgacctgggtccgccaggctccaggggaaggggctgggagtggggtggccaaacataaaacaaagacggaagtcaagaaaaaccctatgtggactctgtgacggccgattcaccatctccagagacaacgccaagaattcactgtatttgcaaatgaaacagcctgagaggcgaggacacggcgtgtattattgtgcgcgagatgatagtacgactctacaagtagcaggtgtangtacttg

SEQ ID NO: 371962 - DNA, 583 bp, Homo sapiens
  misc_feature: GZ8MTXP02G3C6X.15.67.G01.1.454.CMB.2.raw
  modified_base (377)..(377): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccgggggggtccctggagactctcctgtgcagtctctggattcacccttagagttatggatgacctggtccgcaggctccgaggggaggggctggaggtgggtgccaacaataaacgaaagacggaagtcaagaaaaacctntagtggactctgtagacggccgattccaccgatctaccagagacaacgccaagactcactgtattagactaaatgaaacagacctaggagagggacgaagggaccgaacgggccgttagtacgttagttggtcgacggtacgagagtacgaagtagtacgtactacgttaacgaagtacgacgtagggtggtaatcggtaatttgg

SEQ ID NO: 371963 - DNA, 610 bp, Homo sapiens
  misc_feature: GZ8MTXP02HQ58B.15.67.G01.1.454.CMB.2.raw
  modified_base (345)..(345): a, c, t, g, unknown or other
  modified_base (378)..(378): a, c, t, g, unknown or other
  modified_base (386)..(386): a, c, t, g, unknown or other
  modified_base (406)..(406): a, c, t, g, unknown or other
  modified_base (455)..(455): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggaggcttggtccgaggccgggggggtccctgagactctcctgtgcagtctctggacttccacccttagaagttattggatgacctgggtccgcaggctccgaggggagggctggagtgggtgccaaanaataaaacaaagacggaatacaaagaaaacctntgtgactntgtgaccggcatcaccatcncagagacaacgacaaagattcacgtgttacttagacaaaagtcgaaacngacctaggaaggacggacgggaaggaccgaaccgggtccgttagttaaagtttagttgtcggaccgaggaaagtagtaggtaaacgttaaggtaacgacctttccgtaaacgtaaggttaagacgtaaaggggttggtacttaggttactttcgg

SEQ ID NO: 371964 - DNA, 603 bp, Homo sapiens
  misc_feature: GZ8MTXP02FVG5G.15.67.G01.1.454.CMB.2.raw
  modified_base (270)..(270): a, c, t, g, unknown or other
  modified_base (381)..(381): a, c, t, g, unknown or other
  modified_base (391)..(391): a, c, t, g, unknown or other
  modified_base (462)..(462): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtgggggaggcttggtccgagggccgggggggtccctggagactctcctgtgcagtctntggattcaccttagagttattggatgaccgtggtccgccaggctccgaggggagggctgggagtgggtggaccaaacataaaacgaaagacggaagtacaaagaaaacctntggtagactntgtagaccggcattcaccatctcagacgacaacgcaaagtaatcgtactgttatttagacaaaatgaaacncgaccgtaggaagacgggacgggaacggaccgaacggtccggttagtttaagttagttggtcggacgtcggaagtagttggaacttaggtacgtacttacgtaactaaggtacgacggtagggtagtagtggtagtttcgg

SEQ ID NO: 371965 - DNA, 563 bp, Homo sapiens
  misc_feature: GZ8MTXP02GPP6Q.15.67.G01.1.454.CMB.2.raw
  modified_base (305)..(305): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcatggtccaggccgggggggtccctggagactctcctgtgcagtctctggattcacccttagaagttatggatgacctgggtccnccaggctccgagggaaggggctggagtgggtggccaaacataaacaaagacggaaagtcaagaaaaactagtagtaggactcgtagtggaaaccggcgattccaaccatctccagagacaacgccaaagaattcactagtactttgacaaatagaacagctagagagggacgaacggacgacgggaccgttaggtatttagtgtcgaccggagagagtagagtacgtagactacaagagtagacgaggtgtaatgtag

SEQ ID NO: 371966 - DNA, 576 bp, Homo sapiens
  misc_feature: GZ8MTXP02IRAQI.15.67.G01.1.454.CMB.2.raw
  modified_base (302)..(302): a, c, t, g, unknown or other
  modified_base (468)..(468): a, c, t, g, unknown or other
  modified_base (470)..(470): a, c, t, g, unknown or other
  modified_base (472)..(472): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggagcttggtccagccgggggggtccctgagctctcctgtgcagtctctggattcacccttagaagttattggatgaccgtgggtccnccaggctccgaggggaaggggctgggagtggggtggccaaacataaaacaaaggaccgaaagtacaagaaaaacctagtagtcggaatcgtgttagacggggaccgacgttacaccctaactctaccacgagaacacgactaacgaatacatgtattagacaatanananacacgtagagagagacgacgacgtcgtagttagttagtgtcgacgagagtagtagtagtaagtacgtacttactaagtacgacgacggtaggtagtaggtattg

SEQ ID NO: 371967 - DNA, 556 bp, Homo sapiens
  misc_feature: GZ8MTXP02FXWI8.15.67.G01.1.454.CMB.2.raw
  modified_base (375)..(375): a, c, t, g, unknown or other
  modified_base (379)..(379): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggattcaccttagaagttattggatgacctgggtccgcaggctacgaggggaagggctggagtgggtgaccaacaataaacgaaaagacggaatacgaagaaaaactntagngactctgtcgacggcacttcaccatctcaagagaacaaacgaccaaagaattacactgttattagaacaaatcgaaacacgaccgtagagaggacggaagaccgacggccgttagtattagtgtaggcgacgagatgatagacgactcagaagagacgtaggtgtagtaggacttag

SEQ ID NO: 371968 - DNA, 549 bp, Homo sapiens
  misc_feature: GZ8MTXP02FN0GP.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccgggggggtccctgagactctcctgtgcagtctctggattcacccttagaagttattggatgacctgggtccgccaggctccgaggggaaggggctggagtgggtggccaaacataaacaaagacggaagtacaagaaaaacctatgtaggactctgtgacggccgattcaccatctcagagacaacgcaaagatcactgtatttgcaaaatgaaacagacctagagagggacgaggacacgggccgtagtattatgtgcgcgagatgaatagtacgactactaacgaagtagacgtaggtgtaatggatttcg

SEQ ID NO: 371969 - DNA, 618 bp, Homo sapiens
  misc_feature: GZ8MTXP02F2QKX.15.67.G01.1.454.CMB.2.raw
  modified_base (430)..(430): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggagtcgtgggggaggcgttggtccagggccggggggtccctgagactctcctgtgcagtctctggattcacccttagaagttattggatgacctgggtccgccaggctccgaggggaaggggctggaggtgggtggaccaaacaataaaacgaaaagacggaaagtacaaagaaaaacctgtagtggactcgtagtagacgggccgattccaccatctaccaganacaacgccaaagacttcactgttatttagactaaaagtgaaacgacgaccgtaggaagagggacggaagggaacccgacgggtaccggttagttaagtttagttaggtcgacgtcgaagtagtaggtaataggtacgtacttacttaacgaaggttacgacgtagggttaggtactaggtactttagg

SEQ ID NO: 371970 - DNA, 522 bp, Homo sapiens
  misc_feature: GZ8MTXP02ILKU1.15.67.G01.1.454.CMB.2.raw
  modified_base (478)..(478): a, c, t, g, unknown or other
  modified_base (501)..(501): a, c, t, g, unknown or other
tcagtctacgtagccacgaccggtgctcgatttagagtatacatattgggtttgaggtctcagagaggagccttagcccctggactccaaggcctttccacttggtgatcagcactgagcacagaggactcaccatggagttggggctgagctgggttttccttgttgttattttagtaaggtgtccagtgtgaggtgcacttggtggagtctgggggaggcttggtccgaggccgggggggtcccgtgagactctcctgtgcagtctctggattcaccccttagagttatggatgacctggtccgccaggctccaggggaagggctggagtgggtggcaacataaacaaagacgaagtacaagaaaaacctatgtgactctgtgacggccgatcaccatctccagagacaacgcaagaatcactgtattgacaatgaactgcctgagaggcgagtacacggctagtattatgtgcgngagatgatagacgactctaacgngtagcgtaggtagtatgattg

SEQ ID NO: 371971 - DNA, 579 bp, Homo sapiens
  misc_feature: GZ8MTXP02G34WC.15.67.G01.1.454.CMB.2.raw
  modified_base (350)..(350): a, c, t, g, unknown or other
  modified_base (519)..(519): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggtcgttggtccgagggcccgggggggtccctggagacctctcctgtgcagtctcgtggattcacccttagaagttatggatgacctggtccgcaggctccgagggagggcgtggaggtgggtggccaaanataaaacgaaagacggaagtacaagaaaaaccctatagtacggactcgtaggtagacgggccgattccaccactctaccgagagaacaacgaccaaagtaattacgactgtatttgaacaaatagaaacagcctaggagagggacgaaggaccgacggcgtagtaattnttagtgcgtacgagatgaagttagacgactatacgaagtagacgaggtagtatgagtttg

SEQ ID NO: 371972 - DNA, 654 bp, Homo sapiens
  misc_feature: GZ8MTXP02IA4XT.15.67.G01.1.454.CMB.2.raw
  modified_base (311)..(311): a, c, t, g, unknown or other
  modified_base (607)..(607): a, c, t, g, unknown or other
  modified_base (634)..(634): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttattttagaaggtgtccagtgtgaggtgcacgttgggtggaggtcgtgggggaggcgtttgggtccgagggcccgggggggtcctggacgactctcctgtgcagtctctggattcaccttagagttatggatgaccgtggtccncaggctccgaggggagggcgtgggaggtggggtacggaccaaacgaaataaaaacgaaaggaaacggggtaaagtacgaaaagaaaaaacctagtaggtaggacttacgttggtacggaaccggccgtaacttccgaacctactcctaccgagaacgaaccaaaccggacccaaaggtaaacttcgtaaacttagttattttagaaacctaaaatacgaaaacgtcgacccgtagggaaggaacgggacgggaacgggaacgacccgggtacgtagttaagtttagtgtggaccgngagatgatagacgtacttacagtaagngacgtaggtagtatggtatg

SEQ ID NO: 371973 - DNA, 639 bp, Homo sapiens
  misc_feature: GZ8MTXP02HYAKH.15.67.G01.1.454.CMB.2.raw
  modified_base (299)..(299): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcgtgttagttatttagaaggtgtcagtgtgaggtgcacttggtggagtcgtgggggagcttggtccaggccggggggtcctgagactctctgtgcagtctctgattcaccttagaagttattggatgaccgtgggtcccgnaaggctaccgaagggggaagggcgtgggaggtggggtcggaccaaaacaagtaaaaaccgaaagacggaaagtacaaaaggaaaaacctgtagtaggactcgtgtacgacgggtcctattcaccattccaccgagaaacgacaaacggacccaaaggtaacttcaaacgttgtttatttacgaacttaaaagagaaacctagaccgttaggaggaaggacggacgggaacgtaccggggtctttagtagtttagtcgtgacggacgagtagtacgtaagttagggttaaaccgtaccttacgtaacgtaaggtacgacggtaggtagtaattggtacttg

SEQ ID NO: 371974 - DNA, 528 bp, Homo sapiens
  misc_feature: GZ8MTXP02HUYP8.15.67.G01.1.454.CMB.2.raw
  modified_base (408)..(408): a, c, t, g, unknown or other
  modified_base (446)..(446): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttgaagttattggatgacctgggtccgccaggctccaggggaggggctgggagtgggtggccaacataaaacaaagacgaagtcagaaaaacctatgtggactctgtgacggcgattcaccatctccaganacaacgccaagaattcactgtatttgacaaatgaaacngcctgagagggcgaggacacggccgtagtattagtgtgcggcgagatgatacgtagactcacaagtagcaggtgtatgatcg

SEQ ID NO: 371975 - DNA, 599 bp, Homo sapiens
  misc_feature: GZ8MTXP02FUS4B.15.67.G01.1.454.CMB.2.raw
  modified_base (390)..(390): a, c, t, g, unknown or other
  modified_base (563)..(563): a, c, t, g, unknown or other
  modified_base (576)..(576): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgctacgttggtggagtcgtgggggaggcttggtccgaggccggggggtccctgagactctcctgtgcagtctcgtggtattccacccttagtaagttattggatgaccgtggtcccgccaggctaccgaggggaagggctgggagtggggtggaccaaacgaataaaacgaaagacgaaagtcaaagaaaaacctnagtgactcgtagtagacggccagttaccacctatcctacagagaccaaacgacaaagaattccgaatcgttaattgataaaactgaaacacgaccgtagagtagggacgagtaaccgcggtaccgttagttaacttagtgtgcgacgagtaatgaattaaggtacgtaacctntaacgaaggttancggaggtagtaatggtactttag

SEQ ID NO: 371976 - DNA, 548 bp, Homo sapiens
  misc_feature: GZ8MTXP02FPZOF.15.67.G01.1.454.CMB.2.raw
  modified_base (303)..(303): a, c, t, g, unknown or other
  modified_base (435)..(435): a, c, t, g, unknown or other
  modified_base (465)..(465): a, c, t, g, unknown or other
  modified_base (540)..(540): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccgggggggtccctgagactctcctgtgcagtctctggattcacccttagaagttattggatgacctggtccnccaggctccgagggaagggctggagtggggtgccaaacataaaacaaagacggaagtacgaagtaaaaaccctatagtaggaactctagtgacgggccgaattcaccatctccagagacaaacgcaagattnactgtattgacaaatgaaacagacctgagngacggaggacacggccgtagtaattatgtgcgcgagatgatagtacgactacgtacaagtagacgtaggagttangtatttag

SEQ ID NO: 371977 - DNA, 555 bp, Homo sapiens
  misc_feature: GZ8MTXP02HX3W5.15.67.G01.1.454.CMB.2.raw
  modified_base (351)..(351): a, c, t, g, unknown or other
  modified_base (511)..(511): a, c, t, g, unknown or other
  modified_base (527)..(527): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtggggggaggcgttggtccgagggcccgggggggtccctggagactcctcctgtgcagtctctggattcacccttagaagttattggatgacctgggtccgcaggctccgaggggagggctgggagtgggtggccaaanataaacaaagacggaaagtcaagaaaacctatgtgactctgtgacggcgattcaccatctacagagacaaacgccaaagaattcaactgtatttgactaaatgaaacagacctaggaagagggcgaaggacacgggccgtagtattagtgtgcgcgagangatagtacgactacanaagtagacgtagggtagtatggtacttg

SEQ ID NO: 371978 - DNA, 550 bp, Homo sapiens
  misc_feature: GZ8MTXP02FOA1P.15.67.G01.1.454.CMB.2.raw
  modified_base (384)..(384): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccggggggggtccctggagactctcctgtgcagtctctggattcacccttagaagtattggatgacctgggtccgccaggctccaggggaaggggctgggagtggggtggccaacataaacaaaagacggaagtcaagaaaaacctatagnggactctgtgacggccgattcaccatctccagacaacaaccgaccaaagattcactgtatttgcaaaatgaaacagcctgacggaggcggaggacacggccgtgtatattgtgcgacgagatgaagtagtacgactctaacaagtagcgtaggtaggtatcggatg

SEQ ID NO: 371979 - DNA, 738 bp, Homo sapiens
  misc_feature: GZ8MTXP02GU0I6.15.67.G01.1.454.CMB.2.raw
  modified_base (380)..(380): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccgggggggtccctgagactctcctgtgcagtctctggattcacccttagaagttattggatgaccgtgggtccgcaggctccgaggggaagggctgggagtgggtggaccaacataaaacgaaagaacggaagtacaagaaaaaccctntagtaggacttcgtgttacggaccgggaccgtattacccgacctaactcctacccaaggaacgaaccgaaaccgacccaaaagtaaacttcctaacttaggttaacttttacggaacctaaaagttagaaaacgacgtaccttaggaaggacgggacgggaacgggaaccgacccggggtacccggtttaggttaacttttaaggttttcggtcgggtaccgggaccggtaaagggtaaagttacggtaaagtttaaagggttaaacggtaacccttacccggtttaaacgaacgggtttaagggaccggttaaacgggggtttaggggttaactttaacgggtaacgtttttcgggg

SEQ ID NO: 371980 - DNA, 628 bp, Homo sapiens
  misc_feature: GZ8MTXP02GV1UR.15.67.G01.1.454.CMB.2.raw
  modified_base (360)..(360): a, c, t, g, unknown or other
  modified_base (436)..(436): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccgaggccgggggggtccctggagactcgtccggtgcagtctctggattcacccttagaagttattggatgtacccgtgggtcccgccgaggcctccgaaggggaaggggcgtgggaggtgggtggaccaaanaataaaaccgaaaggacggaaagtacaaagaaaaactgtagtggactcgtagtacgaacggccgattcaccatccncagacgaacaacgaccaagaacttacacttgttaacttagaactaaatacgaaacaggcctaagggacgaacgggacggaagggaaccgaaccgggtccgttaggttatttaagttggtacgcggacgagagtagaacgtagtaacgactacgtaacaggtaagacgtagggtaggtatagacgttgtttag

SEQ ID NO: 371981 - DNA, 590 bp, Homo sapiens
  misc_feature: GZ8MTXP02GWO33.15.67.G01.1.454.CMB.2.raw
  modified_base (559)..(559): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggaggtcgtgggggaggtcgttggtccgagggcccgggggggtccctgagactctcctgtgcagtctctggattcacccttagaagttattggatgacctggtcccgcaggctccgaggggaaggggctgggaggtggggtggaccaacaataaaacaaaggaacggaagtacaagaaaaacctatagtaggactctgtacgacggccgattccaccatctccaagagacaaaccgacaaagaattcactagtatttgacaaatacgaaacagaccgttagagagggacggaaggaaccgacgggaccgtagttaagtttagttacggtgccgacgagagtagatagtagactntaacaagtagacgtaggagtaatgaatttgg

SEQ ID NO: 371982 - DNA, 667 bp, Homo sapiens
  misc_feature: GZ8MTXP02H7Y6G.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctgggtccgccaggctccgaggggaaggggctgggaggtggggtggaccaacaataaaacgaaaggaaccggaaagtacgaagaaaaaacctagtagtaggaacgttcgtaggttacggaaccgggcccggtaatttccaaccctatcctaccaagacgaaccaaacggacccaaagaaacttcctaacttaggttaattttacggactaaagttagaaaaccagtaccctaggaagagggaccggaaggacgaccggaccgttggtatttagttggtgcccgacggaggtatagtaaaggttacgtaacggtaccttacgttaaccgaaggttacgaacggttagggtagggttactaggttaatttccggg

SEQ ID NO: 371983 - DNA, 736 bp, Homo sapiens
  misc_feature: GZ8MTXP02IHHG5.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgtttgggtgggaggtcgtgggggaggcgtttggtccgagggcccgggggggtccctggagactctcctgtgcagtctcgtggattcaccttagaagttatggatgaccgtggtccgccaggctccgaggggaaggggctgggaggtggggtcggaccaaaacaagtaaaacgaaaggaacggaaagtacaaagaaaaaaccttagtaggtaggaactcgtaggtacggaaccggggccctaatttaccaaccctatccgtaccaagaacgaaccaaaccgtaccaaaggaaactttacgaacttaggttaattttacggaaacctaaaattacgaaaaccgaacgacccgttaggaagggaaggaccgggttaacgggaaccgaccggggttaccgttaggtttaaacgttttaagttcgggttggtacccggtacggaaggtagttaggtaaagttaaaccgggttataacccgttactaaacgtaacggttaacggacgtaagggggtttaggtagttacggttaagtttccggg

SEQ ID NO: 371984 - DNA, 582 bp, Homo sapiens
  misc_feature: GZ8MTXP02GM1NH.15.67.G01.1.454.CMB.2.raw
  modified_base (530)..(530): a, c, t, g, unknown or other
  modified_base (533)..(533): a, c, t, g, unknown or other
  modified_base (539)..(539): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagactctcctgtgcagtctctggattcacccttagtaagttattggatgaccgtgggtcccgccgaggcctccggaggggaaggggcgtgggaggtggggtcggcccaaacaataaaacgaaagacggaaagtacaaagaaaaacctgtagtaggactctgtagaccggccgattccaccgactctaccaagaacgacaaaccgaccaaagtaattccactacgttatttagactaaatagaaacacgcctaggagaggaggaggaccgacggccgtagtatntgngcgagngatgatagtagacctacgtacaagagacgaggtaggatgattg

SEQ ID NO: 371985 - DNA, 664 bp, Homo sapiens
  misc_feature: GZ8MTXP02HGVHM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtcagtgtgaggtgcacttggtggagtcgtgggggaggcttggtccgaggccggggggtccctgagactctcctgtgcagtctctggattcacccttagaagttattggatgacctggtcccgccgaggctccgaggggaagggcgtggaggtggggtggaccaaacaataaaacgaaaagaacggaagtacgaaagaaaaacctatggtaggacttcgtgtaggaccgggccgtaattccgaacctacttcctaccgaagaacgaaccaaacccggacccaaaggtaaactttaccaacttagttaagttttacgaactaaaagttacgaaaaccaacggtacccgtagggaacggaggggacgggaacgggaaccgaccgggtaccggttagttagtttagttggtagccggacggagtagtggtaagtagtacgtacctcgtaacaaggtacgacgtagggtaggtacgttaggagtttgg

SEQ ID NO: 371986 - DNA, 538 bp, Homo sapiens
  misc_feature: GZ8MTXP02FHZJN.15.67.G01.1.454.CMB.2.raw
  modified_base (515)..(515): a, c, t, g, unknown or other
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttgggtccaggccggggggggtccctgagactctcctgtgcagtctctggattcacccttagaagttattggatgacctgggtccgccaggctccaggggaaggggctggagtggggtggccaaacataaaacaaaagacggaagtcaagaaaaacctatagtggactctgtgacgccgattcaccatctccagagacaacgaccaaagaattcactagtatttgacaaaatgaaacagcctgagaggacgaggacacggccgtgtattatgtgcgcgagatgatagtacgactntacaagtagcaggtgtangattg

SEQ ID NO: 371987 - DNA, 598 bp, Homo sapiens
  misc_feature: GZ8MTXP02F1UCC.15.67.G01.1.454.CMB.2.raw
  modified_base (302)..(302): a, c, t, g, unknown or other
  modified_base (402)..(402): a, c, t, g, unknown or other
  modified_base (589)..(589): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggagcttgggtccaggccggggggtccctgagactctcctgtgcagtctctggattcacccttagattattggatgacctggtccnccaggctccgaggggaagggctggagtgggtggccaaacataaaacgaaagacggaagtcaagaaaacctatgtagactctgtgacggcattcaccatcncagagaaccaaccgccaaagattacgactcggtaattttgactaaaagtcgaaacgagtaccgaggaggagggaccgggaaggaacccggacgggtacccggttaggttaattagttcggttagccggcggtaagattgaaattaggtacgaacttcgtaaccgaagtacggacgagggtgtaacgnggtacttgg

SEQ ID NO: 371988 - DNA, 623 bp, Homo sapiens
  misc_feature: GZ8MTXP02HNR9J.15.67.G01.1.454.CMB.2.raw
  modified_base (350)..(350): a, c, t, g, unknown or other
  modified_base (572)..(572): a, c, t, g, unknown or other
  modified_base (576)..(576): a, c, t, g, unknown or other
  modified_base (596)..(596): a, c, t, g, unknown or other
  modified_base (602)..(602): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatcgaccgtgggtccgccaggctccgaggggaaggggcgtgggagtggggtggaccaaanaataaaacaaaggaacggaaagtacaaagaaaaacctagtagtggactcgtaggtacggaccggccgtaattaccacccgtaactcctacccaagaacgaaaccaaaccggacccaaaaggtaattacccacgtaggtttaattttacggaacctaaaatagaaaacgacgacctaggaagagggacgaacggacgaaccgggcttaggtattatgtagcgngagntagactagtacgactctaanaagtanacgaggtagtatcgtatttcg

SEQ ID NO: 371989 - DNA, 572 bp, Homo sapiens
  misc_feature: GZ8MTXP02JJGTT.15.67.G01.1.454.CMB.2.raw
  modified_base (391)..(391): a, c, t, g, unknown or other
  modified_base (545)..(545): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctggagactctcctgtgcagtctctggattcacccttagaagttattggatgacctgggtccgccaggctccgaggggaaggggctggagtggggtgccaaacataaaacaaagacggaagtacaagaaaaacctgtagtaggactntgtgacgggcattcaccatctacagacacaacgccaaagaattcaactgtaatttgactaaatgaaacagacctaggagaagggccgaaggacgtaccggaccggtagttagttagttgtagaccggcgagataggtaatacgtagactctaanaagtagacgtagggtgtaatggattcg

SEQ ID NO: 371990 - DNA, 578 bp, Homo sapiens
  misc_feature: GZ8MTXP02G3X7L.15.67.G01.1.454.CMB.2.raw
  modified_base (303)..(303): a, c, t, g, unknown or other
  modified_base (374)..(374): a, c, t, g, unknown or other
  modified_base (407)..(407): a, c, t, g, unknown or other
  modified_base (412)..(412): a, c, t, g, unknown or other
  modified_base (418)..(418): a, c, t, g, unknown or other
  modified_base (545)..(545): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggaggtcttggtccaggccggggggtccctgagactctcctgtgcagtctctggattcacccttagaagttatggatgactggtccncaggctccgaggggagggctggagtgggtggccaaacaataaacaaagacggaaagtacaagaaaaacctntgtaggactcgtgtagaccggcattccacatcncaganacaacncaagatcactgttaatttgaactaaatagaaactagacccgtagaaggacgggacggaaggaccgaccgggccgtagttaattaagttgtacgacgtcgagagttgaattaagtacgacttaccaanaaggtacgacgtaggttaggtacttagagtttg

SEQ ID NO: 371991 - DNA, 708 bp, Homo sapiens
  misc_feature: GZ8MTXP02JLSFZ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccaggccgggggggtcctgagactctcctgtgcagtctctggacttcacccttagaagttattggatgactcgggtccgcaggctccgaggggaaggggctgggaggtggggtcgggacctaaacaactaaaacgaaaaggtaccgggaaagtaccaaagaaaaaacccttgtggtaggaactcgtaggtcggaacgggccgtaattccgacctatcctccaaagacgaaccaaaccgaccaaagaacttcactagttaatttcgactaaaatagaaacgacgtcccttaggaacggacggggacggaacggaaccggacggggtacccgttagggtttaactttaaggttggttacggtcccggaaacggtaggtagtttaaacgggaagtttaaggtaccggttaaaccttcccgttaaacggaaaacggttgaccggttaacgggggttaggttaaacgtttcggaacgtttttcggg

SEQ ID NO: 371992 - DNA, 768 bp, Homo sapiens
  misc_feature: GZ8MTXP02FRWU2.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgagggccggggggtccctgagactctcctgtgcagtctctggattcacccttagtaagttagttggatcgaccgtcgggtcccgccgaggcctaccgaggggaaggggctgggaggtggggtcggaccaaacgaaataaaacgaaaaggaacggaaagtaacaaagtaaaaaacctagtaggtaggtaactcgtacggtaggaaccggggccgtaactttacccaaccctacttcccgtaccgaaggaaacggaaacccaaaacccggacccaaaaacggtaaactttacctaaaccgttaggtttaaactttttaggaaacctaaaaagttaacgaaaacccgaacggtacccgttaaggggaacgggaacggggaaccgggaaacgggaacccggaccggggtacccggttagtttaaagtttagttgggtacggccggaacggtaaggtagtaggtaaacgttaaggtaacggtaaccttaccgtaaacgaacggttagacggttagggtagggttaacgtacggttacgtttacgg

SEQ ID NO: 371993 - DNA, 569 bp, Homo sapiens
  misc_feature: GZ8MTXP02FKZVJ.15.67.G01.1.454.CMB.2.raw
  modified_base (406)..(406): a, c, t, g, unknown or other
  modified_base (543)..(543): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagagttattggatgacctgggtccgcaggctccaggggaaggggctggagtgggtggccaaacataaaacaaaagacggaagtcaagaaaaacctatagtggactctgtgacggccgattcaccatcnccagagacaaacgccaaagattcactgtatttgacaaaatgaaacagaccctggaagagggaccggaaggaccgaacggggcccgttaggtaattagttggtgccggacgtaggaattgaattaggacactcgtaanaagttagcagggtggtaatggattcg

SEQ ID NO: 371994 - DNA, 547 bp, Homo sapiens
  misc_feature: GZ8MTXP02FVBAN.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggatcacccttagagttattggatgacctgggtccgccaggctccgaggggaaggggctgggagtggggtggccaaacataaaacgaaaggacggaaagtacgaagaaaaacctatgtggactctgtgacggcgattcaccatctccagagacaacgccaagaattcactgttatttgacaaaatgaaacacgcctagagaggacggaaggacacggccgtggtattattgtgcgcgagatgatagtagactatacaagtagacgaggtgtatgactttg

SEQ ID NO: 371995 - DNA, 671 bp, Homo sapiens
  misc_feature: GZ8MTXP02H1BKH.15.67.G01.1.454.CMB.2.raw
  modified_base (312)..(312): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggcccgggggggtccctggacgacctctcctgtgcagtctctggattcacccttagaagttattggatgaccgtgggtccncaggctccgaggggaggggctgggaggtggggtcggaccaaagaataaaacgaaaggaaaccggaagtacaaagaaaaacctagtaggtaggactcgtggtacggaaccggggcctaattcccacccgaattcctaccaaggacgaaaccaaacccgacccaaagaacttactaacttaggttaattttacgaactaaagtacgaaaacctaacgccgtaaggaaggaacggggacggaaacgggaccgtaaccggggacccgtttagtaagtttaagttgtacgcggcgtaagtagtagagtaagtacgtacttacgtaacgtaaggtagacggtagggtaggtacgtggtatttcgg

SEQ ID NO: 371996 - DNA, 543 bp, Homo sapiens
  misc_feature: GZ8MTXP02HFKY2.15.67.G01.1.454.CMB.2.raw
  modified_base (304)..(304): a, c, t, g, unknown or other
  modified_base (311)..(311): a, c, t, g, unknown or other
  modified_base (420)..(420): a, c, t, g, unknown or other
  modified_base (503)..(503): a, c, t, g, unknown or other
  modified_base (520)..(520): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggcccgggggggtccctgagactctcctgtgcagtctctggattcacccttagagttatggatgacctggtccnccaggcnccgaggggagggctggagtgggtggccaaacataaaacgaaaggaacggaagtacaagaaaaacctgtagtaggactcgtgtgacgggccgattccaccatcaccaganacaacgccaagatcactgtatttgacaaatgaaacagacctagagaggcggaaggacgacggcgtgtattatgtgcgtgagancgatagtagactactanaagtagcagggtgtatggtatcg

SEQ ID NO: 371997 - DNA, 613 bp, Homo sapiens
  misc_feature: GZ8MTXP02HD5LW.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggagactctcctgtgcagtctctggattcacccttagaagttattggatgaccgtgggtccgccaggctccgaggggaaggggctgggaggtgggtggaccaaacgaataaaacgaaaggacggaaagtaccgaaagaaaaaaccctagtggtaggacttcgtggttacggaccgggccgtaattccaaccattccaccgaagaacgaaccaaaccggacccaaagaattcacttgtatttgacaaatgaaacagcctggaagagggacggaaggacgaccggacgttagtatttagtgtgcggacgagatgaagtagtaacgtactacgtaacgaagttagcgtagggtaggtaatggtaatttgg

SEQ ID NO: 371998 - DNA, 590 bp, Homo sapiens
  misc_feature: GZ8MTXP02I1OJ5.15.67.G01.1.454.CMB.2.raw
  modified_base (384)..(384): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaaggtgtccagtgtgaggtgcacttggtggagtcgtgggggagcttggtccaggccgggggggtccctgagactctcctgtgcagtctctggattcacccttagaagttattggatgaccgtcgggtccgccgaggctccgaggggaaggggcgtggaggtggggtcggaccaacataaacaaaggacggaagtacaaagaaaaacctntggtaggactctaggttacggacggccgtattccaccatctacagagacaaccgacaaagaacttcacttgtaatttgactaaagtcgtaaacacgcctaggagacggacgggaaggaccgacgggccgttagtaattacgttggacgcggacgagtatgactagtagactactagaagtagacgtagggtgtaaagtggtattcg

SEQ ID NO: 371999 - DNA, 613 bp, Homo sapiens
  misc_feature: GZ8MTXP02JHNQ1.15.67.G01.1.454.CMB.2.raw
  modified_base (560)..(560): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgcaggctccaggggagggctggagtgggtggccaacaataaacaaagacggaaagtcaagaaaaaacctagtgtaggactcgtagtacgaccgggccgtacttccgacccattcctacccgaagaacgaaccaaaccgacccaaagaactttacgaacttagttaattttgaacctaaaattacggaaacagaccttaggaacgagggacgggaaggaccgaaccgggccgttaggtatttagttcgtgcggcgagntacgattaagtacgacctctaacgaagtaagcgtagggtgtagtcgtagttag

SEQ ID NO: 372000 - DNA, 603 bp, Homo sapiens
  misc_feature: GZ8MTXP02FJWMA.15.67.G01.1.454.CMB.2.raw
  modified_base (192)..(192): a, c, t, g, unknown or other
  modified_base (377)..(377): a, c, t, g, unknown or other
  modified_base (464)..(464): a, c, t, g, unknown or other
tcagtctacgtagccacgaccggtgctcgatttagagtatacatattggggtttgaggtctcagagaggagccttagccctggactccaaggcctttccacttggtgatcagcactgagcacagaggactcaccatggagttggggctgagctgggttttccttgttgttattttagaaggtgtccagtgtnaggtgcacttgtgagtcgtggggtagcttggtccaggccgggggggttccctgagactctcctgtgcagtctctggattcaccttagaagttattggatgacctgggtccgcaggctccgaggggaagggctggagtgggtgaccaacactaaacgaaagacggaagtcaagaaaacccctgtgnggtactcgtgtgaccgccgaattcacctatctaccagacgaacaacggacaagtaactcactgtaattcgactaaaatcggaaaccncgtaccgtagaacggacgggaccggacggaccgaccgggtcttaggttacttagtggtacgacggacgtaagtatacgaaagtacgtacgtacctacgtaaacgaaggtaacgtcgtagggttgtaacgtgtacgtttg

SEQ ID NO: 372001 - DNA, 534 bp, Homo sapiens
  misc_feature: GZ8MTXP02FHNIS.15.67.G01.1.454.CMB.2.raw
  modified_base (504)..(504): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttatggatgactgggtccgccaggctccagggaagggctggagtgggtggccaacataaacaaagacggaagtcaagaaaaacctatgtggactctgtgacggccgattcaccatctccagagacaacgcaaagattcactgtatttagcaaaatgaaacagacctgagaggacgaggaccgacggccgtagtacttattgtgcgcgagatgaataganactcaacaagtagcagggtgtacgtgattg

SEQ ID NO: 372002 - DNA, 718 bp, Homo sapiens
  misc_feature: GZ8MTXP02HLWZX.15.67.G01.1.454.CMB.2.raw
  modified_base (680)..(680): a, c, t, g, unknown or other
  modified_base (705)..(705): a, c, t, g, unknown or other
  modified_base (713)..(713): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagactcaccatggagttgggctgagcgttgggttttccttgttgtttattttagaaggtgtccagtgtgaggtgctacgttgggtggaggtcggtgggggaggtcgttcgggtccgacgggtccccggggggtccctggacgaccttctccgtgtgctagtctcgtggtacttcctaacccgttagaagtttagtggattcgaccgtcggggtcccgccgaggcctccggagggggaacggggcgtagggaagggtcggggtaggaccccaaaagtaaacgtaaaaaacgaaaaggaacggaaaagtacgaaaaagtaaaaacccctagtggtacgacttcgtaggtacggaaccggccgtaattaccaacctacttccgaccaaggaaacgaaccaaaccgaccctaaaagtaactttactaaccttgttaatttacgaactaaaagtacgaaaccgagccgtaaggaggacgggacggaacggaccgaccgggtacgtagttattagttgagaccgagaagtgtaaggtaagtaacggtaacgtccttaacgtanaaggttagaaacgtgggtaaggttntaaggttnttcgg

SEQ ID NO: 372003 - DNA, 577 bp, Homo sapiens
  misc_feature: GZ8MTXP02IS2KN.15.67.G01.1.454.CMB.2.raw
  modified_base (304)..(304): a, c, t, g, unknown or other
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctctgtgcagtctctggattcacccttagaagttattggatgacctgggtccncaggctccgaggggaagggctggaggtgggtggaccaacagtaaaacaaaggacggaagtacaaagaaaaacctagtgtggactgtagtgacgggccgattccacctatcaccgagagacaaacgaccaaagaattacactagttatttagacaaagtagaaacacgcctaggagaggacggaggaccgacgggccgttagtaatttagttggtgccgtcggagagtanagtagtacgacttacagtaagtagcgtaggtggtatgtaatttg

SEQ ID NO: 372004 - DNA, 624 bp, Homo sapiens
  misc_feature: GZ8MTXP02JBV6Y.15.67.G01.1.454.CMB.2.raw
  modified_base (314)..(314): a, c, t, g, unknown or other
  modified_base (501)..(501): a, c, t, g, unknown or other
  modified_base (553)..(553): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcggtgggggaggtcgttggtccgagggcccggggggtcctggagactctcctgtgcagtctcgtggtattccaccttagagttattggatgaccgtgggtcccncgaggcctccgaggggaacgggctgggaggtggggtcggacccaaacgaagtaaaacgaaaggaaccggggaaataccgaaaaggaaaaaacctgtaggtaggacctcgttggacgaccggggcctattcaccatccacagacacaacgaccaaagacttacactgttattagaacaaaatcgaaancgacctggaaggaggacggaacggacgtacggccgttagtattagttcgggngcgagagtagtagagtaacgtacgtactacgtaacgaaggtcggacggtagggttacgtagtagtacgttg

SEQ ID NO: 372005 - DNA, 799 bp, Homo sapiens
  misc_feature: GZ8MTXP02JRA5Y.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggagtcgtgggggaggcttggtccaggccggggggtccctgagactctcctgtgcagtctctggattcaccttagaagttatggatgacctggtccgcaggctcccgaggggaacggggctagggacggttggggtcgggacccaaaacgtaataaaaaccgaaaacggaaaccggggtaaaacgttaccgaaaaggaaaaaaaccccgttagttcggttaacgggaaccttcgtagggttacggaacccggggcccgtaaatttaccccgaaacccctagttacccttacccgaaagggaacgaaacccgaaaacccggacccgaaaaaggtaaactttacccaaacgtttaccgggttaaatttttcggaaacctaaaaacgtagggaaaacccacggtacccgttagggaacggacggggacgggaacggggaacccgaacggggtcccggttaaggtacgtttaagtttggtaacggcccgacggtaaggtacgtacgggtaaattaaaccgggttaacgaaccgttacccgttaacgaaagggttaaccgacggtaaggggttacggggtacttacggtacggtttaacgg

SEQ ID NO: 372006 - DNA, 610 bp, Homo sapiens
  misc_feature: GZ8MTXP02JGRBL.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttatttagaaggtgtccagtgtgaggtgcacttggtggagtcgtggggggaggcgttgggtccgagggcccggggggggtccctggagacctctcctgtgcagtctctggattcacccttagaagttattggatgacctgggtccgccaggctccgaggggaaggggctgggaggtggggtggccaaacaagtaaaacaaagaaccgggaaagtcgaaagaaaaaaccctataggtaggtaacctcgtggttagaccggggcccgtaattccaacccatcctacccaagacgacaaacgacccaaagaacttcaacttgtaatttagacaaatagaaacagacctagaggaggacggaagggaccgacgggaccgtggtattattgtgcgcgagatagataggtacactacctacaagtagacgtaggtagtatggtattgg

SEQ ID NO: 372007 - DNA, 595 bp, Homo sapiens
  misc_feature: GZ8MTXP02G88V7.15.67.G01.1.454.CMB.2.raw
  modified_base (467)..(467): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttgggtccgagggcccgggggggtccctggagacctctcctgtgcagtctctggattcacccttagagttatggatgacctgggtccgccaggctccgaggggaagggctggagtgggtggaccaacataaacaaagacggaaagtacaaggaaaaacctatagtggaactctagtacgacgggccagttacaccatctcagagacaacgaccaagaattcactgtattgacaaatagaaacanccgtaggaaggacgggacggaaggaccgacgggtaccgtaggttaattagttgtgcggacgtagataggaagtaaggtaactactacttaacaaggttacgacggagggttggtaactggtagtttcg

SEQ ID NO: 372008 - DNA, 544 bp, Homo sapiens
  misc_feature: GZ8MTXP02FF6JP.15.67.G01.1.454.CMB.2.raw
  modified_base (421)..(421): a, c, t, g, unknown or other
  modified_base (539)..(539): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagttattggatgacctgggtcccgccaggctccgaggggaaggggctgggagtgggtggccaaacataaaacaaaagacggaaagtacaagaaaaaccctatgtggactctgtgacggccgattcacatctccaganacaacgccaaagaattcactgtatttgacaaatgaaacagcctgagaggacggaggaccacggccgtgtatatgtgcgcgagatgataagacgactctaacaagtacgcaggtgtaangattg

SEQ ID NO: 372009 - DNA, 657 bp, Homo sapiens
  misc_feature: GZ8MTXP02GDHST.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcggtgggggaggtcgtttggtcccgagggtccccgggggggttccctggacgtaccttcctcctgtgcagtctctggattcacccttagaagttattggatgaccgtgggtcccgccaggctccgaggggaagggctggaggtgggtggccaaacaagtaaacaaaaggacggaagtacaaagaaaaacctgtgtaggactgtaggtacggaccgggtccgaatttccgaacctacttcctacccgaagaaacgaaaccaaaccggacccaaaagtaacttaccaacttagtttatttacgaactaaaagagaaacgaacgccgtaggagagggaccgtaaggaccgaccggcgtagttattagtgtagcggtacgagtatagtaagtaacgtacgtactccgttaaacgaaggttagaccgtagggtagttagtagaacttttgg

SEQ ID NO: 372010 - DNA, 531 bp, Homo sapiens
  misc_feature: GZ8MTXP02FIDC3.15.67.G01.1.454.CMB.2.raw
  modified_base (477)..(477): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccgggggggtccctgagactctcctgtgcagtctctggattcacccttagaagttattggatgactgggtccgcaggctccagggaaggggctggagtgggtggccaaacataaaacaaagacggaaagtacaagaaaaacctatgtaggactctgtgacggccgattcaccatctccagagacaacgaccaaagaattcactgtatttgcaaaatgaaacagcctgagaggcgagacacggcgtntatatgtgcgcgagatgatagtacgactctaacaaggtacgcaaggtgatgatg

SEQ ID NO: 372011 - DNA, 576 bp, Homo sapiens
  misc_feature: GZ8MTXP02JET69.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagactctcctgtgcagtctctggattcacccttagagttatggatgaccgtggtccgccaggctccgaggggaaggggctggagtgggtggaccaacaataaaacaaaggacggaagtacgaaagaaaaacctatgtaggacttcgtgtacgacggggccgtaattccaccatctaccagacgacaacgccaaagattcactgtatttgactaaatgaaacacgccgtagagagggcgaaggaccgacggccgtagttattagttgtgcgacgaggtataggaatagtacgactacctagaaggtaacgcgtaggttgtatcggagttg

SEQ ID NO: 372012 - DNA, 550 bp, Homo sapiens
  misc_feature: GZ8MTXP02JKWMI.15.67.G01.1.454.CMB.2.raw
  modified_base (378)..(378): a, c, t, g, unknown or other
  modified_base (456)..(456): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgacctgggtccgcaggctccgaggggaagggctgggagtgggtggaccaaacataaaacaaaggacggaagtacaagaaaaacctntagtgactctgtagaccggccgattccaccatctccagacgacaacgccaagattcactgtatttgacaaatgaaacngcctgagaggacggagacgacggcgtagtattattgtgcgtcgagataggatagtacgactcgtaacaagtagacgtagggtgtatagtatttg

SEQ ID NO: 372013 - DNA, 560 bp, Homo sapiens
  misc_feature: GZ8MTXP02GE6YM.15.67.G01.1.454.CMB.2.raw
  modified_base (311)..(311): a, c, t, g, unknown or other
  modified_base (341)..(341): a, c, t, g, unknown or other
  modified_base (378)..(378): a, c, t, g, unknown or other
  modified_base (387)..(387): a, c, t, g, unknown or other
  modified_base (406)..(406): a, c, t, g, unknown or other
  modified_base (409)..(409): a, c, t, g, unknown or other
  modified_base (434)..(434): a, c, t, g, unknown or other
  modified_base (452)..(452): a, c, t, g, unknown or other
  modified_base (492)..(492): a, c, t, g, unknown or other
  modified_base (528)..(528): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcattggtggagtcgtggggggaggcttggtccgagggccggggggtccctgagactctcctgtgcagtctctggtattccaccttagaagttattggatgacctggccgcaggcncgaggggaggctgggagtggggtgaccaanaataaaacgaaaggacggaagtacaagaaaaacctgngtgactcgngtaggaccgcgattcaccntcncagacgacaacacaaagtatcactnttattagacaatgaaacngacgtgagaggacgaaggacgacggcgtagtagttatggngacgtacgagtagtcgaagtacgtagtactacgtanaaaggtgtacgtagggtagtagtcgagtttcg

SEQ ID NO: 372014 - DNA, 783 bp, Homo sapiens
  misc_feature: GZ8MTXP02HWO34.15.67.G01.1.454.CMB.2.raw
  modified_base (342)..(342): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccgaggccggggggtcctggagactctcctgtgcagtctctggattcacccttagaagttatggatgacctgggtccgccaggctccgaggggagggctggagtgggtggccaanaataaaacgaaagacggaaagtacaaagaaaaacctagtagtggaacttcgtaggtacgaccgggtccgtaactttccaccctaatcccttaccaaaggaacgaaccaaaacccggacccaaaaaggtaaactttacccgaaacttagggtttaaactttttcggaacctaaaaagttacgaaaaccgaacggtaccccttaagggtaacgggaaacggggaccgggaaacggggaaacccgtaacccgggggtacccgggtttaggttaaacgttttaacggttagggttcggtaccggggaccggtaaaagggttagttaaccgggtaaacgtttaaagggtaaacggttaaaccctttcccggtaaaacgtaaaggggtttaacggaacccggtaaagggggttacggttaaaacgtttcggggttaaaactttcggg

SEQ ID NO: 372015 - DNA, 602 bp, Homo sapiens
  misc_feature: GZ8MTXP02FOL7D.15.67.G01.1.454.CMB.2.raw
  modified_base (357)..(357): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgcacgttggtggagtcggtggggggaggtcgttgggtcccgacgggcccgggggggtccctggagactctcctgtgcagtctcgtggattcacccttagaagttattggatgacctggtccgccaggctccgaggggaagggctggaggtgggtggccaaanataaaacgaaagacggaagtacaaagaaaaacctagtgtaggactcgtagttaggaccggccgtattaccaccatcctaccagaacgacaaaccgccaaagaattcactgttaatttgacaaaatgaaactgcctagaggaggacggaaggacgaacgggtccgtaggttattagttgtgccgaggagagtagaataagtacgtactctaacgaagttacgagtagggtgtacgtgtatttacgg

SEQ ID NO: 372016 - DNA, 765 bp, Homo sapiens
  misc_feature: GZ8MTXP02GISA0.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtgggagtcggtgggggaggtcgttgggtccgacggggcccgggggggttccctggacgaccttccgtccgtggtgcgtagtcttcgtggtattcctaacccttaagtaagttagttggatcgaccgtcgggtcccgccgaggcctccggaaggggaacgggcgtaggaggtggggtcggacccgaaaacaaagtaaaaacgaaaaggaacggaaagtacgaaaaggaaaaaacccttgtaggtacggaacttcgtaggtacggaccggggcctaacttaccgaaccctacgtcctaccgaaagaacgaaaccaaaccgacccaaaagtaacttacctaacgttcggtttaaatttacggaaacctaaaaagttacgaaaaaccgtacgtacccgttaggaaacggacggggacgggaaacgggaaaccgtaccggggtaccgttaggttaatttacggttgaacggtcggacggaagtagttacggaaagttaacggtaacgtaacctacgtaaacgtaaggttacggacggtaaagggttgtaaagtcggttagtttacgg

SEQ ID NO: 372017 - DNA, 581 bp, Homo sapiens
  misc_feature: GZ8MTXP02JTQ19.15.67.G01.1.454.CMB.2.raw
  modified_base (309)..(309): a, c, t, g, unknown or other
  modified_base (330)..(330): a, c, t, g, unknown or other
  modified_base (339)..(339): a, c, t, g, unknown or other
  modified_base (345)..(345): a, c, t, g, unknown or other
  modified_base (386)..(386): a, c, t, g, unknown or other
  modified_base (406)..(406): a, c, t, g, unknown or other
  modified_base (411)..(411): a, c, t, g, unknown or other
  modified_base (443)..(443): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccgaggcccgggggggtccctggagactctcctgtgcagtctctggattcaccttagaagttattggatgacctgggtccncaggctccgaggggagggcgnggagtgggngccaanataaacaaagacggaagtacaagaaaacctatagtgactcngtagacggcgatccacatcncaganacacgaccaagatacactgtatttgactaaanataaacacgacctaggacgagggacgggaaggaccgacggtaccggttagtagttagttagtcgcgtacggagtaagtgtaagtaacgttagaaccttacgttacgaaggtacgacgtagggtaggtatggatttcgg

SEQ ID NO: 372018 - DNA, 536 bp, Homo sapiens
  misc_feature: GZ8MTXP02FVQXZ.15.67.G01.1.454.CMB.2.raw
  modified_base (333)..(333): a, c, t, g, unknown or other
  modified_base (361)..(361): a, c, t, g, unknown or other
  modified_base (476)..(476): a, c, t, g, unknown or other
tcagtctacgtagccacgaccggtgctcgatttagagtatacatattgggtttgaggtctcagagaggagccttagccctggactccaaggcctttccacttggtgatcagcactgaacacagaggactcaccatggagttggggctgagctgggttttccttgttgttattttagaaggtgtccagtgtgaggtgcacttggtggagtctgggggagcttggtccaggccgggggggtccctggagactctcctgtgcagtctctggattcacccttagaagttatggatgactggtccgcaggctcgagggaggggctggagtggtgcaanataaacaagacgaagtcaaagaaaactntgtgactctgtgaacgccgatcacatctcagagacaacgaccaagaattcactgtatttagactaaaatgaacagacctagagaggcgaggacgacggcgtgtattagtgtgcgngagagtagagtagtacgtactactacgagtaagacgtaggtaggtagtagtagttagttg

SEQ ID NO: 372019 - DNA, 673 bp, Homo sapiens
  misc_feature: GZ8MTXP02I8J0L.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgacctgggtcccgccgaggcctccgaggggaaggggctgggaggtggggtggacccaaacgaataaaacgaaaggacggaaagtacgaaagaaaaaccctagtggtaggactcgtaggtacgacgggccgtaattccacccatcctaccagacgacaacggaccgaacgtaaagtaactactacgttagtttactacgaaactaagaacgaacgaccgtaccgaggaacgggacgggaaccggacggaaccgggtaccgggtacgttacggtttaagtttagtcggtacggtaccggaggtaagtacgtaaggtaagttaacgtaacgtacgtaaccgtaaggtaacgtaggtacggtaggttacggtagtacggtttagg

SEQ ID NO: 372020 - DNA, 543 bp, Homo sapiens
  misc_feature: GZ8MTXP02IM0J7.15.67.G01.1.454.CMB.2.raw
  modified_base (453)..(453): a, c, t, g, unknown or other
  modified_base (462)..(462): a, c, t, g, unknown or other
  modified_base (488)..(488): a, c, t, g, unknown or other
  modified_base (492)..(492): a, c, t, g, unknown or other
  modified_base (497)..(497): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagttattggatgacctgggtccgccaggctccgaggggaaggggctgggagtgggtggccaacgataaacaaagacggaagtacaagaaaacctatgtagactctgtgacggcgattcaccatctaccagagacaacgaccaaagatcactgttatttgacaatgaaacngcctagagnggacgagacgacgcgtgtattattgngcgngaganagatagtacgactctaacgaagtacgacgtaggtagtatgatttgg

SEQ ID NO: 372021 - DNA, 537 bp, Homo sapiens
  misc_feature: GZ8MTXP02FJIMD.15.67.G01.1.454.CMB.2.raw
  modified_base (415)..(415): a, c, t, g, unknown or other
  modified_base (500)..(500): a, c, t, g, unknown or other
tcagtctacgtagccacgaccggtgctcgatttagagtatacatattgggtttgaggtctcagagaggagccttagccctggactccaaggcctttccacttggtgataagcactgagcacagaggactcaccatggagttggggctgagctgggttttccttgttgttattttagaaggtgtccagtgtgaggtgcacttggtggagtcgtggggggaggcttgggtccaggcccgggggggtcctgagactctcctgtgcagtctctggattcacccctagaagttattggatgacctgggtccgccaggctccgagggaaggggctggagtgggtggccaaacataaaacaaagacggaagtacaaagaaaaactatgtagactctgtgaacggcgattcaccatctcaganacaacgccaaagaattcactgtatttgacaaatagaacagcctagagaggcgaggacaacggccgtagtattatgtgcgcgagangatagtagactcacagtaagcaggtgtatgatcgtta

SEQ ID NO: 372022 - DNA, 583 bp, Homo sapiens
  misc_feature: GZ8MTXP02JJ9JK.15.67.G01.1.454.CMB.2.raw
  modified_base (492)..(492): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagagttattggatgacctggtccgccaggctccgaggggaaggggctggaggtggggtggccaaacagtaaaacaaaggacggaagtacgaagaaaaaaccctatagtaggaacttcgtggttacgaacggggcccgaattacccgaacctagtccctaccagaacgaaccaaacgacccaaagaattacactgtatttgacaaatgaaacngacctagagaggcgaagtacgacggccgtagtattagttgtgcgacgagatagatacgtagactcacaagtagacgaggtgtatcgagttg

SEQ ID NO: 372023 - DNA, 584 bp, Homo sapiens
  misc_feature: GZ8MTXP02ITHGM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccgaggccgggggggtccctggagactctcctgtgcagtctctggattccacccttagaagttattggatgacctgggtcccgcaggctccgaggggaagggctggaggtgggtcggaccaaacaataaaacgaaaggacggaagtacaaagaaaaacctatgtggactcgtagtagaccggcgaattccaccatcctaccagacgaacaaacgaccaaagaacttcacttagttatttagacaaaatgaaacacgacctagaggaggacgaagggaccacggaccgtagttattattggcgcgtacgagatagagtatacgactacgtaacaaggtaagcgaggtagtatggtacttg

SEQ ID NO: 372024 - DNA, 597 bp, Homo sapiens
  misc_feature: GZ8MTXP02F0TF2.15.67.G01.1.454.CMB.2.raw
  modified_base (474)..(474): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccgagggcccgggggggtccctggagactctcctgtgcagtctctggattcaccttagaagttattggatgaccgtgggtcccgcaggcctccgaggggaagggcgtagggaggtggggtggaccaaacaataaaacgaaaggacggaagtacaaagaaaacctgtgagactctggtacgacggctattcacctatctacagacgacaacgaccaaagattcacttgtattgactaaaagtgaaacncgaccgtaggaaggacgggacggaaggacccgacgggtacgttagttattagttggtacgcgagtagatagaatacgacgtacctcgtaacgaagttacgacgtaggtgtacgtagcgtttag

SEQ ID NO: 372025 - DNA, 556 bp, Homo sapiens
  misc_feature: GZ8MTXP02FYOO4.15.67.G01.1.454.CMB.2.raw
  modified_base (350)..(350): a, c, t, g, unknown or other
  modified_base (447)..(447): a, c, t, g, unknown or other
  modified_base (532)..(532): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggcttggtccgaggcccgggggggtccctggagactctcctgtgcagtctctggattcacccttagaagttattggatgacctgggtccgccaggctccgaggggaagggctggaggtgggtggccaaanaataaaacgaaagacggaagtcaaagaaaaacctatagtaggactctagtgacgggccgattccaccatctccagagacaaacgccaaagatcactntatttgacaaatgaaacagcctaggagagggacgaggaccgacggccgtagtatagtgtagcgagagatgagtagtagactctanaagtacgctaggtgtatcggtatg

SEQ ID NO: 372026 - DNA, 555 bp, Homo sapiens
  misc_feature: GZ8MTXP02JX9SD.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggcccgggggggtccctggagactctcctgtgcagtctctggattcacccttagaagttattggatgacctggggtccgccaggctccaggggaaggggctggagtgggtggccaaacataaaacaaaagacggaaagtcaagaaaaaaccctatgtggactctgtgacggccgattccacatctccagagacaacgcaaacgaatcactgtatttgacaaatgaaacagcctagagaggcgaaggacacggaccgtgtattattgtacgcgcgagatggataggtacgactactacaagtacgacgagggtagtactagagttg

SEQ ID NO: 372027 - DNA, 699 bp, Homo sapiens
  misc_feature: GZ8MTXP02G5DU3.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttatttagaaggtgtccagtgtgaggtgctacgttggtggaggtcggtgggggaggtcgttgggtccgacgggtcccgggggggtccctggacgaccttcctccgtggtcgctagtctcgtggtacttcctacccttagtaagtttattggatcgaccgtgggtcccgccaggctccgaggggagggctgggagtgggtgaccaaacaagtaaaacaaagacggaagtacaaagtaaaaaacctgtaggtaggactcgtagtacggaccgggccgtaattccaaccagttccaccaagaacgaacaaacccgaccaaagtaacttcacttaggttatttaggacctaaaagtagaaacgacgtacctaggaagggacggacgggaaacgggaaccgtaaccgggcccggttaagttaagtttaagttggtcggtacccggtacggagtaagtaggtaaacgttagggtaacgaaccttacgttaaacgaaggttacgacggtaagggttggtaaacgttggaaacgtttgg

SEQ ID NO: 372028 - DNA, 549 bp, Homo sapiens
  misc_feature: GZ8MTXP02GBGZN.15.67.G01.1.454.CMB.2.raw
  modified_base (419)..(419): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtggggggaggcttggtccgagggccgggggggtccctggagactctcctgtgcagtctctggattcacccttagaagttatggatgacctgggtccgccaggctccgaggggaggggctggagtgggtggccaacataaaacaaagacggaagtacaagaaaaacctatgtggactcgtgtagacggccgattcaccatctacaganacaacgcaaagaattcactgttattgactaaatgaactagcctagagagacgagacgacggcgtgtatattgtagcgtcgagtatgaagtagacgtactctacgaagtacgacgaggtgtatagatttcg

SEQ ID NO: 372029 - DNA, 557 bp, Homo sapiens
  misc_feature: GZ8MTXP02HZQ48.15.67.G01.1.454.CMB.2.raw
  modified_base (304)..(304): a, c, t, g, unknown or other
  modified_base (342)..(342): a, c, t, g, unknown or other
tcagtctacgtagccacgaccggtgctcgatttagagtatacatattgggtttgaggtctcagagaggagcccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcttggtcccaggccggggggtccctgagactctcctgtgcagtctctggattcacccttagaagttatggatgacctgggtccnccaggctccgaggggaagggctggagtgggtggccaanataaaacaaagacggaagtacaagaaaaacctatagtggactctgtagaccgggcattcaccatctcagagacaacgccaagaattcactgtatttagactaaatgaaacagacctagagaggacgaaggacacgggcctagtattagttgtgcgacgagatagataacgtagactacctagaagttacgacgtaggtagtaagtgtaactttgg

SEQ ID NO: 372030 - DNA, 551 bp, Homo sapiens
  misc_feature: GZ8MTXP02HRU4H.15.67.G01.1.454.CMB.2.raw
  modified_base (259)..(259): a, c, t, g, unknown or other
  modified_base (420)..(420): a, c, t, g, unknown or other
  modified_base (459)..(459): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggccggggggtccctgagactctcctgtncagtctctggattcacccttagaagttatggatgaccgtgggtcccgcaggctccgaggggagggctgggaggtgggtggaccaacaataaaacaaagacggaaagtacaaagaaaacctatggtgacttctaggtgaccggcgtaatcaccatctcaganacaacgaccaaagattcactagttattgacaaatgaacngcctgagagcgagacgacggacgtgtaacttgtgtcgcgagagtatagattagacgactcacgtaagtagactagggtaggactagtagttc

SEQ ID NO: 372031 - DNA, 822 bp, Homo sapiens
  misc_feature: GZ8MTXP02FL2D1.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccgagggccggggggtccctggagactctcctgtgcagtctctggattcacccttagaagttattggatgacctgggtccgccaggctccgaggggaacggggctgggaggtcggggtggacccaaaacgaagtaaaaccgaaaaggaaccgggaaagtaccgaaagaaaaaaccccttagtaggtaggtaaccttcgtgggttacggaaccggggcccgaaatttcccaaccctaacgttacctaccccgaaaggtaaccgaaacccgaaaacccgacccgaaaacggtaaactttacccgtaaccttacggtttaagtttttacggaacctaaaacgttacggaaaacccgtaacggtaccccgttaaggggaacggaacggggaaccgggtaacggggaaacccggtaacccgggggtaccccggttaaggtttaaaccgtttaaacggtttgggttacgggtacccggtaccgggtaaaggtagttaacggtaaaagttaaacggttaaccgtaaccgttacccgttaaacgtaaacgggttacgaccggttaaacgggggtttaggttaacggtaacggttagttttaacgg

SEQ ID NO: 372032 - DNA, 704 bp, Homo sapiens
  misc_feature: GZ8MTXP02G1FKI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgctacgttggtggaggtcggtgggggaggtcgttggtccgagggcccggggggtcctgacgctctccgtgtcgctagtctcgtggtacttcctaccttagtaagtttagttggactcgaccgttcgggtcccgaccgaggccgtaccggaagggggaacggggtcgtaggggaggtcggggtacggaaccaaaactaaagtaaaacgaaaaggaacggtaagtaacaaaagtaaaacctgtaggtacgactcgtaggacggaccgggtctacttccgaacctataccgtacgaagaacgaaccaaaccgactaaagtacttcacgttgtagttacgaacaaagtacgaaacgcgtaccgtaaggacggacgggacgggaacggaacccggtacggttacggttagtttaagttaggtcggtacggccggtaaggtaagagttagtaacgttaacgtacgaacttaccgagtaaggtcgtaggtacggtggtataccggttagtttacgg

SEQ ID NO: 372033 - DNA, 660 bp, Homo sapiens
  misc_feature: GZ8MTXP02ITRTF.15.67.G01.1.454.CMB.2.raw
  modified_base (348)..(348): a, c, t, g, unknown or other
  modified_base (391)..(391): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttctgttgttatttagaaggtgtcagtgtgaggtgcacgttggtgggagtcgtggggggaggcgtttggtccgaggccggggggtccctggagactctcctgtgcagtctctggattcacccttagaagttattgggatgacctgggtccgccaggctccgaggggaagggcgtggaggtgggtgccaaanataaaacaaagacggaagtacaagaaaaacctatgtaggactntgtgaccggcgattcaccatctaccagagacaacgaccaaagaacttacgacttagttatttacggactaaatagaaaacacgtaccgtagaaggacgggacggaaacgggacgaaccgggtccgttagttaaacgtttaagttagggtcgacggtcggaaggtaaagttcggaaaacgttaggttaaacggtaccttttaaccgaaacgttaaaggttaacggacgttaaaaggggttcgggttaacgttacggttaacgttttacgg

SEQ ID NO: 372034 - DNA, 539 bp, Homo sapiens
  misc_feature: GZ8MTXP02JW85C.15.67.G01.1.454.CMB.2.raw
  modified_base (344)..(344): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaagggctgggagtgggtggccaanataaaacaaagacggaagtacaaagaaaaacctatgtaggactcgtgtagacggccgattcgaccatctccagagacaacgccaaagatcactgtatttgacaaatgaaacagctgagaggcgagacgacggctgtattagtgtgcgtcgagatgatagacgtactactacgaagtactcgaggtagtatgattg

SEQ ID NO: 372035 - DNA, 568 bp, Homo sapiens
  misc_feature: GZ8MTXP02FT7NK.15.67.G01.1.454.CMB.2.raw
  modified_base (345)..(345): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagagttattggatgacctgggtccgccaggctccgaggggaaggggctggagtgggtggccaaanataaacgaaagacggaagtacaagaaaaacctagtagtggaactctagtgacggccgattcaccatctccaagacgaacaaccgaccaaagaaattcaactgtatttagactaaaatgaaacagacctaggagaggcgaaggacgacggccgtgtattagttgtgcgacgagtagtagatagtagacttcgaactaagtagacgtaggtggtaatggatttgg

SEQ ID NO: 372036 - DNA, 688 bp, Homo sapiens
  misc_feature: GZ8MTXP02I9VH6.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggccggggggtccctggagacctctcctgtgcagtctctggattcacccttagaagttattggatgaccgtgggtcccgccacggctccgaggggaacggggcgtgggaggtggggtgggaccaaacgaataaaacgaaaaggacggaaagtacgaaagaaaaacctagtagtaggacttcgtagtacgacggccgattcgacccatcctacagacgacaacgaccaaagtaacttcactacgtatttacgacaaaagttcgaaacacggaccctagggaagaggggaccggaaaggggacccgtaccggggacccggtttaggttaagtttagttaggttggaccggtaacggtaggaagttagggtaaacttaaggttaaacggtaacccgttacgtaaaacctaagggtaaaggtaccgtagggggtaggttaaaggttcggttaaactttcggg

SEQ ID NO: 372037 - DNA, 582 bp, Homo sapiens
  misc_feature: GZ8MTXP02G8VLJ.15.67.G01.1.454.CMB.2.raw
  modified_base (538)..(538): a, c, t, g, unknown or other
  modified_base (557)..(557): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttgggtggagtcggtgggggaggtcgttgggtccgagggcccgggggggtccctggagactctcctgtgcagtctctggattcacccttagaagttattggatgacctgggtccgccaggctccgaggggaaggggctggagtggggtggccaacataaaacaaagaacggaagtacaagaaaaacctatgtaggactcgtgtgaccgggccgtaattccaccatcctacccaagacgaaccaaaccgccaaagaattcacttgtatttgacctaaatagaaacagaccctggaagagggacgaggaccacgggcgtagtattagtgtgcgtagagtnacgtataggtacactcaanaagtagcgtaggtgtatcggatttg

SEQ ID NO: 372038 - DNA, 579 bp, Homo sapiens
  misc_feature: GZ8MTXP02GQU9I.15.67.G01.1.454.CMB.2.raw
  modified_base (306)..(306): a, c, t, g, unknown or other
  modified_base (345)..(345): a, c, t, g, unknown or other
  modified_base (378)..(378): a, c, t, g, unknown or other
  modified_base (463)..(463): a, c, t, g, unknown or other
  modified_base (547)..(547): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattccacccttagaagttatggatgacctgggtccnccaggcctccgaggggaagggctggagtgggtgaccaanagtaaaacaaagacgaagtacaaagaaaacctntgtgactgtgtagacggcgattacgacctatctaccagacgaccaaacgtaccaaagtatctaactgtattgacaaatacgaaanagtaccagagagacggaagaaccgacggacgtgtaatttagtgacgtcgacgagtagtagtaagtaacgtacgactacgttaanaacggtagacgaggtagtactaggtatttcgg

SEQ ID NO: 372039 - DNA, 608 bp, Homo sapiens
  misc_feature: GZ8MTXP02HR6X1.15.67.G01.1.454.CMB.2.raw
  modified_base (349)..(349): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggcttggtccaggccgggggggtccctgagactctcctgtgcagtctctggattccacccttagaagttattggatgacctgggtccgccaggctccgaggggaagggctgggagtggggtggccaaanataaaacaaaggacggaaagtacaaagaaaaacctagtgtaggactctggtagaccggggtccacttcacctagtctccaagacgaaccaacgacaaagattccattgttaatttcgactaaaagtcgaaaacagaccttaggaaggacgggacggaacggacgtacggggccgttaggttaattagttgtgaccgtcgaggatgagtaacgtgaacttcgtaacaaggttacgagtagggtagtagtagtagtttcgg

SEQ ID NO: 372040 - DNA, 690 bp, Homo sapiens
  misc_feature: GZ8MTXP02HJS7W.15.67.G01.1.454.CMB.2.raw
  modified_base (542)..(542): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgaccgtgggtccgccaggcctcgaggggagggtcgtaggaggtgggtcggaccaaacaagtaaaacgaaaacggaacggaaagtacgaaaagaaaaaccttagtaggtacggaacgttcgttacggtacggaaccggggcccttaacgttaccaaccctaactaccctaccgaaggaaacgaaaccaaacccgaacccgaaaagttaacttacacgttagtacttttaggaacctaaaattacgaaacncggaccgtaggaagacgggacggtaagggaccgtaacgggtccgtagttatttagttggtacgaccggtacgaagtagtacggaagttaacgtacgtactaccgtaaagtcggtaacggacggtaggtaggtagttacggtactttgg

SEQ ID NO: 372041 - DNA, 605 bp, Homo sapiens
  misc_feature: GZ8MTXP02I6ZW3.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtggaggtgcacttggtggagtcgtgggggaggcgttggtccgaggcccgggggggtccctggagactctcctgtgcagtctctggattcacccttagaagttatggatgacctgggtccgccaggctcgaggggaagggcgtggaggtggggtggaccaaacaataaaacgaaaggacggaaagtacaagaaaaaacctgtagtaggaacttgtggacggaaccgggcccgaattccaacccgatctacccaagacgaaccaaacgccaaagaattcactgtaatttgacaaaattgaaacagcctagagaggcggaaggaacgacgggaccgtgtaagttagtgtgcgtacgagatagagttagtacgtactacgtaacgaagtagacggtaggttggaagttaggtactttagg

SEQ ID NO: 372042 - DNA, 568 bp, Homo sapiens
  misc_feature: GZ8MTXP02ICZ0W.15.67.G01.1.454.CMB.2.raw
  modified_base (312)..(312): a, c, t, g, unknown or other
  modified_base (378)..(378): a, c, t, g, unknown or other
  modified_base (411)..(411): a, c, t, g, unknown or other
  modified_base (466)..(466): a, c, t, g, unknown or other
  modified_base (532)..(532): a, c, t, g, unknown or other
  modified_base (543)..(543): a, c, t, g, unknown or other
  modified_base (548)..(548): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccgaggccgggggggtccctgagactctcctatgcagtctctggattcacccttagaagttatggatgacctgggtccgcaggcnccgaggggagggctggaggtgggtgaccaaacaataaaacgaaagacggaagtacaagaaaactanggtgactctgtacgacgccgattccactatccncagacgaacaacgtaccaaagtaacttcacttagtactttagactaaatgaaacngtcctagagacggtcgaaggacgacggacgtgtattagtgtgccgtagagtagtagtactaggtanacttcgtaacngttancggtaaggtgtatcgtagtg

SEQ ID NO: 372043 - DNA, 553 bp, Homo sapiens
  misc_feature: GZ8MTXP02FV8XW.15.67.G01.1.454.CMB.2.raw
  modified_base (379)..(379): a, c, t, g, unknown or other
  modified_base (390)..(390): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcaccttagagttatggatgacctggtccgccaggctccgaggggaaggggctgggaggtggggtggccaaacgataaacgaaagacggaagtacaagaaaaacctntagtggactcngtgacggccattcaccatctccagagacaacgcaaagaattcactgtattgacaaatagaacagcctagagacggacgaggaccacggccgtagtattattgtgcgacgagatgaagtacgtacgaactcttaacgaagtagactagggtgtagtgactttgg

SEQ ID NO: 372044 - DNA, 611 bp, Homo sapiens
  misc_feature: GZ8MTXP02HZPSW.15.67.G01.1.454.CMB.2.raw
  modified_base (351)..(351): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccgaggccggggggggtccctggagactctcctgtgctagtctcgtggattcacccttagaagttatcggatgacctgggtcccgcaggctccgaggggaggggcgtggaggtgggtggccaanaataaaacaaaggaacggaaagtacaaagaaaaaacctagtaggtggaacttctaggttacgaccggtccgtaattccaccatctaccaagaagaaccaaacggaccctaaagaacttcacttagttatttacgaaataagtagaacagacgagaggaggacggacgacgtacggtacgtagtagttagtgtacgacgtacgagtagtagtagtacgtacgtactacgacgtaagtacgacgtaggtagtagtagtagtg

SEQ ID NO: 372045 - DNA, 602 bp, Homo sapiens
  misc_feature: GZ8MTXP02JT8BG.15.67.G01.1.454.CMB.2.raw
  modified_base (430)..(430): a, c, t, g, unknown or other
  modified_base (500)..(500): a, c, t, g, unknown or other
  modified_base (559)..(559): a, c, t, g, unknown or other
  modified_base (580)..(580): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttgggtggagtcgtgggggaggcttgggtccgagggcccgggggggtccctggacgactctcctgtgcagtctctggattcaccttagaagttattggatgacctgggtccgcaggctcgaggggaagggctgggagtgggtcggaccaaacaagtaaaacaaaggaacggaaagtcaaagaaaaaccctgtagtcgactcgtgtacgacgggtccgaacttcgaacccntccctacgaacgacgaacgaaccgacccaaagaacttacaacttagtatttagactaaaatgaaaaccgngtacccgaggagaagggacggaaggacgaacgggtcgtagttacttagtgtgcgcgagntacggattagtacgactcagngtagcgaggtgtagtgtattag

SEQ ID NO: 372046 - DNA, 670 bp, Homo sapiens
  misc_feature: GZ8MTXP02IGPJZ.15.67.G01.1.454.CMB.2.raw
  modified_base (381)..(381): a, c, t, g, unknown or other
  modified_base (602)..(602): a, c, t, g, unknown or other
  modified_base (610)..(610): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgtttatttagaaggtgtccagtgtgaggtgcacgttgggtgggagtcggtgggggaggtcgttgggtccgagggcccgggggggtccctggagactctccgtgtgcagtctctggtattccaaccttagtaagttatcggatcgaccgtcgggtccgccgaggctaccggaaggggaaggggtcgtaggggtaggtcggggtacggacccaaaanaaactaaaaacgaaaggaacgggtaaactaacgaaaacgtaaaaacctagtcggtaggaaccttcggtaggtacggaccggggcctaattcccgaacctactccgtacaagacgaacaaccgtaccaaagtactcacttagttattacgaacaaagtgaaacgtacgtaccgaggaggacgggacggaagaccggacggccgttaagtatttagtcgtcgngtacgagngtacgaaagtacggtatactacgataaggtacgacgtaggttaggtattaggtatttacg

SEQ ID NO: 372047 - DNA, 566 bp, Homo sapiens
  misc_feature: GZ8MTXP02I2TEE.15.67.G01.1.454.CMB.2.raw
  modified_base (326)..(326): a, c, t, g, unknown or other
  modified_base (328)..(328): a, c, t, g, unknown or other
  modified_base (331)..(331): a, c, t, g, unknown or other
  modified_base (344)..(344): a, c, t, g, unknown or other
  modified_base (361)..(361): a, c, t, g, unknown or other
  modified_base (442)..(442): a, c, t, g, unknown or other
  modified_base (535)..(535): a, c, t, g, unknown or other
  modified_base (559)..(559): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgttgggttttccttgttgttattttagaaggtgtccagtgtgaggtgcacttggtggagtcgtgggggaggcttggtccagggccggggggtccctggagactctcctgtgcagtctctggattccacccttagaagttattggatgacctggtccgccagcgtcgagggagggngnggnggtggtggcacanaaacaaagaagaagtanaagaaaacgtaatgtgactctgtgacggcgactcaccatctcacagacaacgacaacgaaattcactgtattagtacaaanagtacactaccgtacgagagggacggaggaaccgcgggaccgttagtagttagtgttggcgcggagagtagtagtaagtaggtaactacgtanaacgtaggacgaggtaggtagtanacgtttg

SEQ ID NO: 372048 - DNA, 681 bp, Homo sapiens
  misc_feature: GZ8MTXP02G7MCM.15.67.G01.1.454.CMB.2.raw
  modified_base (341)..(341): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtcagtgtgaggtgcacttggtggagtcgtgggggaggcgttggtccaggccgggggggtccctgagactctcctgtgcagtctcgtggattcacccttagaagttatggatgacgtggtccgcaggctccgagggagggctggagtgggtcgaccaaanaataaaacaaaggaaccggaaagtacaaagaaaaaaccctagtagtaggaactcgtaggttaacggaccgggccgtaattcccaaaccgtaattccacccaaggaaacgaaaccaaacgaacccaaaaggtaaactttacgaactttagtaaacgttttacgaacctaaaattacgaaaaccgacgtaccgttagggaagacgggacgggaaacggaaccgacgggacccggttaggttaatttacgttgtcggacggtacggaagtagttagaagttaaacggtataccgtacgtaagtaagtaaggtacgtaaggggttagtagtacggttagtttag

SEQ ID NO: 372049 - DNA, 623 bp, Homo sapiens
  misc_feature: GZ8MTXP02H5D7Q.15.67.G01.1.454.CMB.2.raw
  modified_base (268)..(268): a, c, t, g, unknown or other
  modified_base (312)..(312): a, c, t, g, unknown or other
  modified_base (336)..(336): a, c, t, g, unknown or other
  modified_base (351)..(351): a, c, t, g, unknown or other
  modified_base (376)..(376): a, c, t, g, unknown or other
  modified_base (429)..(429): a, c, t, g, unknown or other
  modified_base (548)..(548): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgtttgttattttagaaggtgtccagtgtgaggtgcacgttggtggagtcgtgggggaggtcttgggtccgagggcccgggggggtccctgagactctcctgtgnagtctctggattccaccttagaagttatggatgacctgggtccnccaggctccgaggggagggctggnggtggtggaccaaanataaaacgaaagaaggaatacgaanaaaaacctgtagtaggacttctaggtacgacgggcctattaccaccattaccnccaagaacgaaccaacgaccctaaagaacttcgaaactttgttaatttgaacctaaagtacgaaacagccgtaggagacgggagaacggaccgacggcttaggtatttagtgtgaccgnggagattgaaagtacgttacgacctttcgaaacgtaaggtaggtaaaggttacggtaatggttattacggtttag

SEQ ID NO: 372050 - DNA, 606 bp, Homo sapiens
  misc_feature: GZ8MTXP02ICRCA.15.67.G01.1.454.CMB.2.raw
  modified_base (585)..(585): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcattggtggagtcgtgggggaggcttggtccagggcccggggggtccctgagactctctgtgcagtctctggattcacccttagaagttatggatgaccgtgggtccgccaggctccgaggggaaggggcgtgggaggtggggtcggaccaaacgaataaaacgaaaggaacgggaagtacaaagtaaaaacctagtggtggaactcgtaggtacgacggccgtaattccaaccctagtccctaccaagacgaacaaaccgaccaaagtaattcacttgttaatttagaactaaatgaaacacgtaccaggaaggagggacggagggaaccgacgggtacgtagttaagtttgtggtggaccgtgagatgaagtagtacgactctaagngtagcgtaggtgtatgtattg

SEQ ID NO: 372051 - DNA, 725 bp, Homo sapiens
  misc_feature: GZ8MTXP02JV7S1.15.67.G01.1.454.CMB.2.raw
  modified_base (352)..(352): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttgggtcccgaggccggggggtcctggacgactctcctgtgcagtctcgtggacttcaccttagaagttagtggatacgacgtggtcccgcagaccgtccgaggggaacgggctggagtgggtcgaccaaanaagtaaacaaggaacggtacgtacaagtaaaacctgtagacgtactgtagacgacggccgtaattccgaacctagtcctacggaacgagtaacccgaacgacctaaagtaacgttcctaacgttaggtaactttacgaacgttaaacgtacgtaaaacgtacgtaccgttaggaacgggacggtacgggaaccggtaaccggtaacccgggtcggtttaaacggttactttacggttcggtacggacggttaacggtacggttagtaacgggtaagttaaaccgggttacgtaacccgttacgtaacggtaacggttaacggcccgggttaaagggtttacgggttaacgttaccgggtaaggttttaaccgg

SEQ ID NO: 372052 - DNA, 679 bp, Homo sapiens
  misc_feature: GZ8MTXP02I8959.15.67.G01.1.454.CMB.2.raw
  modified_base (642)..(642): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggccggggggtccctgagactctcctgtgcagtctcgtggattcacccttagagttatggatgacctgggtccgccaggctccgaggggaaggggctggaggtgggtggaccaaacgaataaaacgaaaggaacggaagtacaaagaaaaacctagtagtaggactcgtggtacgaccgggccgtaattaccacctatcctaccgaaagaacgaaccaaaccggaccctaaagtaacttaccgtaaacttggttaatttagaacctaaaatacgaaaaccgtacgaccgttagggagacggggacggaaacgggaaccgtaaccggggcccgttagggttaaatttaggtttagggcggtcccggacgggtaacgagttaagggaattaacgggtagtaaccttaccgtaanaaggttaaccgagtaggggtagtagtaggatttccgg

SEQ ID NO: 372053 - DNA, 783 bp, Homo sapiens
  misc_feature: GZ8MTXP02IJQQ8.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggagactctcctgtgcagtctctggattcacccttagaagttattggatgaccgtgggtccgccgaggcctccgaggggaaggggctgggaggtgggtggccaaacaataaaacgaaaaggacggaaagtaccgaaagtaaaaaaccctagtagtaggacttcgtaggtacggaccggggccgtaatttccgaaccctattcccgtacccgaaggaaacgaaaccgaaacccggacccaaaaggtaaactttacccgaaacgtttagtttaaacgtttttacggaaacctaaaaattacgggaaaaccctaacggtaccccgttaagggaaacggggacgggggaacccgggaaacggggaaccccggtaaacccgggggtaccccggtttagggttaaacgtttttaaggtttgggttaacgggccgggtaccgtaagggtaaagttacggaaaaggtttaaggtaacgtaaccgttacctaaacggtaaggttacgacggttaaggggttaggttaacgtaggttaacgtttcgg

SEQ ID NO: 372054 - DNA, 549 bp, Homo sapiens
  misc_feature: GZ8MTXP02FGIWS.15.67.G01.1.454.CMB.2.raw
  modified_base (270)..(270): a, c, t, g, unknown or other
  modified_base (376)..(376): a, c, t, g, unknown or other
  modified_base (379)..(379): a, c, t, g, unknown or other
  modified_base (402)..(402): a, c, t, g, unknown or other
  modified_base (408)..(408): a, c, t, g, unknown or other
  modified_base (431)..(431): a, c, t, g, unknown or other
  modified_base (540)..(540): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccggggggggtccctggagactctcctgtgcagtctntggattcacccttagaagttattggatgacctgggtccgcaggctcaggggaaggggctggagtgggtggccaacataaacaaagacggaagtcaagaaaaacctntgnggactctgtgacgcgattcaccntctcanagacaacgccaaagaattcactntatttagcaaaatcgaaactagcctaggagaggcggaaggaccgacggccgtagttacttagtgtgcgtcgagatgaatagtagactctacgaagtagcgagggtgtanaggtcttag

SEQ ID NO: 372055 - DNA, 606 bp, Homo sapiens
  misc_feature: GZ8MTXP02FHJ0Q.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgaccgtgggtcccgccaggcctccgaggggaaggggctgggaggtgggtcggccaaacaataaaacgaaaaggacggaaagtacaaagaaaaacctatagtggactctgtagacggccgattcaccatctccagagacaacgccaaagaatcactgttaatttgacaaaatgaaacacgaccgtagaaggacggacggaaggaaccgaacgggccgttaggttaattagttgtacgcggacgagattaggaattaacggaagtaccctagtaacgaaggtacgacgtaaagggtgggttaatcggtatttacgg

SEQ ID NO: 372056 - DNA, 663 bp, Homo sapiens
  misc_feature: GZ8MTXP02I8VUB.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctggagactctcctgtgcagtctctggattcacccttagaagttatggatgaccgtgggtccgccaggctccgaggggaggggctggaggtgggtggccaaagataaacgaaagacggaagtacaagaaaaacctatgtaggactctggtcgacgggccgattccaccctatccacgagacgaacaacgaccaaagaattcgaactgttaatttgaccgtaaaatcgaaaacacggtaccctgggaacgacgggcggaaacggggtacccgaaccggggcccggttaggtttaacgtttaggtttccggtaggcccggtacggaaaggtattacgggtaaattaaggtacggtaaaccttcgttaaaccgaaggtttaccggaacgttaggggtacgttaacgttcggtaagttttcgg

SEQ ID NO: 372057 - DNA, 557 bp, Homo sapiens
  misc_feature: GZ8MTXP02GUCB6.15.67.G01.1.454.CMB.2.raw
  modified_base (400)..(400): a, c, t, g, unknown or other
  modified_base (406)..(406): a, c, t, g, unknown or other
  modified_base (494)..(494): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgagggagggctggagtgggtgccaacataaacaaagacgaagtcaagaaaacctatgtgactctgtgacggccgattccaccatcnccaganacaacgcaagaattcatcgtatttgacaaatagaaactacgcctgaagaggacggaaggaccgacgggccgtagtacttagttacggngtcgacgagtatggtaataggacgactctaacaagtacgcgtaggtaggtatagagtttacgg

SEQ ID NO: 372058 - DNA, 577 bp, Homo sapiens
  misc_feature: GZ8MTXP02JHOHF.15.67.G01.1.454.CMB.2.raw
  modified_base (480)..(480): a, c, t, g, unknown or other
  modified_base (490)..(490): a, c, t, g, unknown or other
  modified_base (552)..(552): a, c, t, g, unknown or other
  modified_base (569)..(569): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccgagggcccgggggggtccctggagactctcctgtgcagtctctggtattcacccttagaagttattggatgaccgtgggtccgccaggcctccgaggggaacggggctgggaggtggggtggccaaacaataaaacgaaaggaccggaaagtaccaaagaaaaaccctgtaggtgacctgtagtacgaccgggccgattccaccatacctccagaacgacaaacgaccaaagtattcacttgttatttganaaatgaaacngctagagaggcgagaccgacggcgtgtattagtgtgcgcgagatgactagtacgactactanaagtgacgtaggtgtangtatttcg

SEQ ID NO: 372059 - DNA, 571 bp, Homo sapiens
  misc_feature: GZ8MTXP02GDJS2.15.67.G01.1.454.CMB.2.raw
  modified_base (379)..(379): a, c, t, g, unknown or other
  modified_base (495)..(495): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggacttcacccttagaagttattggatgacctgggtccgccaggctccgaggggaaggggctggagtggggtggccaacataaacgaaagacggaagtcaagaaaaacctntgtggactctgtgacggcatcaccatctccagagacaacgcaaagaatcactgtatttgacaaatgaaacacgacctgaacgaggacggaggaccgacggccgtagtattagttgngcggtacgagtagtggtaagtaacggtagaccttctaaacgtaagtacgacgtagggtggtaactggtaactttgg

SEQ ID NO: 372060 - DNA, 558 bp, Homo sapiens
  misc_feature: GZ8MTXP02I9UT1.15.67.G01.1.454.CMB.2.raw
  modified_base (340)..(340): a, c, t, g, unknown or other
  modified_base (414)..(414): a, c, t, g, unknown or other
  modified_base (494)..(494): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggagcttggtccaggccgggggggtcctgagactctcctgtgcagtctctggattcatccttagaagttattggatgacctgggtccgccaggctccgagggaggggctggagtgggtggaccaanataaaacaaagacggaaagtcaaagaaaaactatgtggactctgtggaacgccgattccacctatcctccaganacaacgcaagaattcactgtaatttgacaaatagaaacagcctagagaggacgaaggacgacggcgtagttattagttgngcgacgagagtagtaactagtacgacttacgtaacgagtacgtacgtaggtacggtagtagtag

SEQ ID NO: 372061 - DNA, 606 bp, Homo sapiens
  misc_feature: GZ8MTXP02FG86E.15.67.G01.1.454.CMB.2.raw
  modified_base (309)..(309): a, c, t, g, unknown or other
  modified_base (478)..(478): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggctttgggtccagggccgggggggttccctggagactctcctgtgcagtctctggattcacccttagagttattggatgacctgggccnccaggctccgaggggaggggctggagtgggtggaccaacataaacgaaaggacggaagtcaaagaaaaaccctgtaggtggactgtgtaggaccgccgattcacctatcctaccgagacgaacaaaccgtaccaaagacttacactagttacttgacaaaatcgaaacngcctgagacgggacggaggtaccgaacgggccgtagttacttagtggtcggcggtacgagactagaagtacggtaacgtacctactaacgtaaggtacgcggtaaggtggttacgtaaggttacgtcg

SEQ ID NO: 372062 - DNA, 568 bp, Homo sapiens
  misc_feature: GZ8MTXP02HZYV2.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggcttggtccaggccgggggggtccctgagactctcctgtgcagtctctggattcacccttagaagttattggatgacctgggtccgccaggctccaggggaaggggctggagtgggtggccaacataaacaaagacggaagtacaagaaaacctatgtaggactctggtagaccgggccgacttaccacccatctaccagacgacaacgaccaagaattcactgtactttgacaaatgaaacagacctaggagagggacgaggaccgacggcgtagtattagttagtgcgtcgagatagatacgtacgacgtactacaagtagacgtaggtaggtagtgacgtttag

SEQ ID NO: 372063 - DNA, 543 bp, Homo sapiens
  misc_feature: GZ8MTXP02HSXQ8.15.67.G01.1.454.CMB.2.raw
  modified_base (340)..(340): a, c, t, g, unknown or other
  modified_base (497)..(497): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttattggatgacctggtccgcaggctccaggggagggctggagtgggtggccaanataaaacaaagacggaaagtcaaagaaaaacctatagtggactctgtagacgggccgattcaccatctccagagacaacgccaaagattcactgtatttgacaaatagaaacagcctgagagggacgagacgacggtccgtgtattaagtgtagcgngagatgatagtacgactctacaagtagcgtaggtgtaatgatttcg

SEQ ID NO: 372064 - DNA, 565 bp, Homo sapiens
  misc_feature: GZ8MTXP02GE8W7.15.67.G01.1.454.CMB.2.raw
  modified_base (468)..(468): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggattcacccttagaagttattggatgacctgggtccgccaggcctccgaggggaagggctggagtggggtggccaaacaataaaacgaaagacggaagtacaaagaaaaaccctatagtaggactctaggtagacgggccgattccaccgtatctaccagacgacaacgccaaagattcactgtattgacaaatgaaacngcctagagaggcgagacgacggccgtagtagttatagtgcgtacgagagtgaagtacgtacgactctaacgaagtaacgcgaggttggtatgatttg

SEQ ID NO: 372065 - DNA, 541 bp, Homo sapiens
  misc_feature: GZ8MTXP02FG4UD.15.67.G01.1.454.CMB.2.raw
  modified_base (380)..(380): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttattggatgacctgggtccgccaggctccaggggaaggggctggagtggggtggccaaacataaaacgaaaagacggaagtcaagaaaaacctntagtggactcgtgtgacggccgattcaccatctccagagacaacgccaaagaattcactgtatttgacaaatgaaacagacctgagaggcgaaggacacggcgtgtattagtgtgcgcgagatgatagtagactctaacaagtacgcgagggtgatcgatg

SEQ ID NO: 372066 - DNA, 671 bp, Homo sapiens
  misc_feature: GZ8MTXP02FYAID.15.67.G01.1.454.CMB.2.raw
  modified_base (311)..(311): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtggggggaggcttgggtccgacgggcccgggggggttccctggagactctcctgtgcagtctctggattcaccttagagttatggatgaccgtggccnccaggctccgaggggagggctgggagtgggtcgaccaaagaataaaacgaaagaacggaagtacaaagaaaaacctgtgtaggactcgtaggtaggaccggctaattccaacctagttcctaccgaagaacgaaccaaaccgacctaaaagaaactttcccaactttaggtttaacttttagaaactaaaaagtcgaaaaccgaagtcccggtaggaaggaggggaccggaaagggacccgtacgggtaccggttaggtttaaacttagttggtcggccggaacggaggtataggtaaagttaggtaaccctactaccgtaaagaaggtagacgtaggggttagttagagtagtttccgg

SEQ ID NO: 372067 - DNA, 539 bp, Homo sapiens
  misc_feature: GZ8MTXP02JJLP3.15.67.G01.1.454.CMB.2.raw
  modified_base (380)..(380): a, c, t, g, unknown or other
  modified_base (410)..(410): a, c, t, g, unknown or other
  modified_base (413)..(413): a, c, t, g, unknown or other
  modified_base (420)..(420): a, c, t, g, unknown or other
  modified_base (427)..(427): a, c, t, g, unknown or other
  modified_base (446)..(446): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggacttcacccttagagttattggatgacctgggtccgcaggctccgaggggaagggctggagtgggtggaccaaacaataaaacaaaggacggaaatacaagaaaaaacctntagtgactctagagacggcattcaccatcncanagacacncaagatnactgtattgacaaatgaanagacctagagagacggagacgacgcgtagtattatagtgcggacgagatagagtagtacgactacactaagtagacgtaggtagtagtagatg

SEQ ID NO: 372068 - DNA, 676 bp, Homo sapiens
  misc_feature: GZ8MTXP02IVEQS.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcgttggtccagggcccggggggtccctggagactctcctgtgcagtctctggattcaccttagagttatggatcgaccgtggtccgcaggctccgaggggaggctggagtgggtcggaccaaagaagtaaaacgaaaggacggaaagtacgaaaagaaaaacctataggtaggactctggtacgaccggtccgaattaccgaaccactctaccgaagaacgaacaaccgaccaaacgtaacttacaacgttagtaatttagaacgtaaagtagaaacgagtaccgtaggagacgggacgggaacgaaccggacgggcccgttaggtaacgtttaagttgtacgtacggtaccgtaaggtagttaggaaagttaacgggtaacgtaaacccgttacggtaaacgtaaggtaccggtaacgtacgggggttagtaaacggttcggtaacgttttcgg

SEQ ID NO: 372069 - DNA, 563 bp, Homo sapiens
  misc_feature: GZ8MTXP02IYVPM.15.67.G01.1.454.CMB.2.raw
  modified_base (380)..(380): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtcccaggccgggggggtccctggagactctcctgtgcagtctctggattcacccttagaagttattggatgacctgggtccgccaggctccgaggggaaggggctgggagtggggtggccaacataaacaaagacggaagtcaagaaaaacctntgtggactcgtgtgaccggccgattccaccatctccagagacaacgaccaagaattcactgtatttgacaaatgaaacagcctaggacgagggacggaaggacgaacgggcgtgtaattattagtgcgagagagtggattagtacgactcacgaagtaacgcgaggtgtaagttgaacgtttg

SEQ ID NO: 372070 - DNA, 628 bp, Homo sapiens
  misc_feature: GZ8MTXP02GDTLW.15.67.G01.1.454.CMB.2.raw
  modified_base (345)..(345): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggtcttgggtccgacgggcccgggggggtccctggagacctcctcctgtgcagtctcgtggattcacccttagaagttattggatgacctggtccgccaggctccgaggggagggctggagtgggnggccaacaataaacaaagacggaaagtcaaagaaaaacctgtgtaggactcgtgtaggaccggccgtaattccgacctatcctccaagacgaacaaccgaccaaagaacttcaacgtgttatttacgacctaaaagtcgaaaacacgacccgtaggaggagggaccggaagggaacccgacgggtccgtagttaatttagttggtcgcggacgtaagaggttaagagttaagtacgaccttaccgtaagaagtacgacgtagggtagtagtggtaacgtttgg

SEQ ID NO: 372071 - DNA, 735 bp, Homo sapiens
  misc_feature: GZ8MTXP02GYPEX.15.67.G01.1.454.CMB.2.raw
  modified_base (310)..(310): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcggtgggggaggcttggtccgaggcccgggggggtccctggagacttctcctgtgcagtctctggattcacccttagaagttattggatgacctgggtccnccaggctccgaggggaaggggcgtggaggtggggtggcccaaacataaaacgaaaaggacggaaagtaccgaaagaaaaaaccctagtaggtaggaacttcgtaggttacggaaccggggcccgtaatttcccgaaccccgtaatccctacccgaaggaaccggaaacaaaacccggacccaaaaggtaaacctttacgaaacccttaggttaagtttttacggaacctaaaaattacggaaaaccaacgaccccgttaggaacgggaacgggaccgaagttacgaaccggacccggggtaccgttaggttaatttagttagggtcgtaccggtaggaagtacgttagtaaattaccgggtaatacccgttaacgtaaccgtaaggtacggacggtaaaaggggttcggttaagtacggtttaag

SEQ ID NO: 372072 - DNA, 658 bp, Homo sapiens
  misc_feature: GZ8MTXP02G3ZY7.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggtcgttgggtccgagggcccgggggggtccctggagacctctcctgtgcagtctctggattcaccttagaagttatggatgacctggtccgccaggctccgaggggaaggggctgggaggtggggtcggacccaaacaataaaaacgaaaggaacggaaagtacaaagaaaaaccctgtgtaggactcgtgtacgaccgggccgtaattccacctatcctaccagaacgacaaaccgacaaagaacttcacttgtatttacgactaaatgaaacacgccgtaggaaggacgggacggaacggaaccgacggggtaccgttagttaagttagttggtcggacggacgtaaggtatacggtaagttaaacggttacgaacctttaccgttaaacgaacggttaaggacggtaaggggttaggtagtacggtaacgtttgg

SEQ ID NO: 372073 - DNA, 796 bp, Homo sapiens
  misc_feature: GZ8MTXP02F65EP.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggccgggggggtccctgagacctctcctgtgcagtctctggattcacccttagaagttattggatgacctgggtccgccaggcctcgaggggaaggggctgggaggtgggtcggaccaaacaataaaacgaaaggaacgggaaagtacaaagaaaaacctagtaggtaggacttcgtaggtacggaaccgggtccgaatttccgaaccctacgttccctaaccccgaaaggaaacgaaacccgaaaacccggacccgtaaaaaggtaaaactttaccctaaacgttaccggtttaattttacggaaacctaaaaacgttagaaaaccgtacgtacccgttaaggacgggtaaggggaccgggaaagggaacccggtaaccgggggtacccggttaaggtttaaacgtttaacggtttacgggttggaaccccgggacggtaaagggtagttaacggtaaaggtttaaggtaaacggtaacctttaacccgttaaacgtaaaggggttaaaccggtacggttaaagggggtttagggtttaacgtacggggtaaactttttcggg

SEQ ID NO: 372074 - DNA, 616 bp, Homo sapiens
  misc_feature: GZ8MTXP02HB59O.15.67.G01.1.454.CMB.2.raw
  modified_base (379)..(379): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttgggtccgaggccgggggggtccctggagactctcctgtgcagtctctggattcacctagagttattggatgacctggtccgccaggctccgaggggaaggggctggagtgggtggaccaacaataaacaaagacggaagtcaaagaaaaaccctntagtggactcgtggtcgaaccgggccgtacttccaaccctatctaccagaacgacaaacgaccaagaattcaactgtactttgacaaatgaaactacgaccgtgaaggagggcggaacggacgaccgggcccgttagtacgtttagttacggtggacccggtacggaagtagttagaattaaacggtagtaaccttctaacgaaggttacgacgtacgggtagtatcgaagtttcgg

SEQ ID NO: 372075 - DNA, 548 bp, Homo sapiens
  misc_feature: GZ8MTXP02I4RPE.15.67.G01.1.454.CMB.2.raw
  modified_base (451)..(451): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccggggggtccctgagactctcctgtgcagtctctggattcacccttagaagttattggatgacctgggtccgccaggctccaggggaagggctggagtggggtggccaaacataaacaaagacggaaatcaagaaaaaccctatgtggactctgtgacgggccagttccaccatctacagagacaacgccaaagattcactgtatttgacaaatgaaacancctagagagggcgaaggacacggccgtggtaattgttgtgccgacgagtatgatagtacgtactctaagaagttaggcgtaggtgtacgtgtagtcg

SEQ ID NO: 372076 - DNA, 601 bp, Homo sapiens
  misc_feature: GZ8MTXP02IUCTK.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgagtgcacttggtggagtcgtgggggaggcttggtccgagggccggggggtccctggagctctcctgtgcagtctcgtggattcacccttagaagttatggatgaccgtgggtccgccaggctccgaggggaaggggcgtggggaggtggggtcggaccaaacgtaaactaaaaacgaaaaggacggaaagtacgaaaggaaaaaacctagtagtaggacttcgtgtacgacggccgtattaccaccatctaccaagacgaacaacgaccaaagtaacttaccacgttagttaatttagaacaaatagaaacacgaccgtagagaggacggaacggacgaccggtactgtaagttattgagcgacgagatagatagactacacgtagaagtagcgtaggtgtagtgtagttg

SEQ ID NO: 372077 - DNA, 606 bp, Homo sapiens
  misc_feature: GZ8MTXP02JLQSG.15.67.G01.1.454.CMB.2.raw
  modified_base (304)..(304): a, c, t, g, unknown or other
  modified_base (374)..(374): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctgggtccncaggctccgaggggagggctggagtgggtgaccaacataaacaaagaccggaagtacgaagaaaaacctntagtaggacttcgtagtagaccgggccgtattaccacccagttcctacccgaaaggaacgaacgaaaccgacccaaaagaacttacctactagttaatttagaaccaaaattaggaaacaggaccctaggagaagggacggaaggacgacggaccgtagtaattgttgtgcgacggagagtgaatagtacgtactacacaaggtagacgtagggtgtacgttgaagtttcgg

SEQ ID NO: 372078 - DNA, 567 bp, Homo sapiens
  misc_feature: GZ8MTXP02HCF4X.15.67.G01.1.454.CMB.2.raw
  modified_base (301)..(301): a, c, t, g, unknown or other
  modified_base (338)..(338): a, c, t, g, unknown or other
  modified_base (345)..(345): a, c, t, g, unknown or other
  modified_base (397)..(397): a, c, t, g, unknown or other
  modified_base (400)..(400): a, c, t, g, unknown or other
  modified_base (517)..(517): a, c, t, g, unknown or other
  modified_base (539)..(539): a, c, t, g, unknown or other
  modified_base (559)..(559): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtcagtgtgagtgcacttggtggagtcgtgggggagcgttggtccaggccgggggggtccctgagactctcctgtgcagtctctggattcacccttagaagttatggatgacctggtccncaggctcgaggggaagggctggagtgggtggcaaaanataaaanaaaggaacgaagtcaaagaaaaactatgtgatctgagacgcgtatcacatcncanagacaaacgcaaagacttacactagtatttagactaaaagtcgaaaacgataccgtagaaggagggacgaacgggtacgaacgggccgttagtacgtttaatggtagcgtacgaggntagatacgttagactacgtaanaagtacagtaggtaggttanacgtatcg

SEQ ID NO: 372079 - DNA, 747 bp, Homo sapiens
  misc_feature: GZ8MTXP02JNX50.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcgttgggtccgagggcccgggggggtccctggacgaccgtctccgtgtgctagtctcgtggattcacccttagaagttattggatcgacctcgggtcccgccgaggcctccgaggggaacggggcgtgggtaggtggggtcggaaccaaacgaaataaaacgaaaacggaacgggaaagtacaaagaaaaaacctagtagtacgggaacttcgtaggtacgaaccggggccgtaatttacccgaaccctatcctaccaggaaacgaaccaaaccggacctaaagtaaacttaccgtaaacttacgttaacttttacgaactaaaagtacgtaaaaccgacgtacccgttacggaaggacgggacgggacggaaaccgacggtcccggttaggttaactttagttggttggacggacgaaggtacgtacggtaaagttaacggtaacgtaccgtttaaccgtaaacgtaacgggtaaacgtacggttaagggggtttacggtaaacgttcggtaacggtttttacgg

SEQ ID NO: 372080 - DNA, 582 bp, Homo sapiens
  misc_feature: GZ8MTXP02FS7PC.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttgggtccgagggcccgggggggtccctggagactctcctgtgcagtctctggattcacccttagaagttattggatgacctgggtccgccaggctccgaggggaaggggctggagtgggtgaccaaacaataaaacaaaagaacggaagtacaaagaaaaacctatgtaggactcgtgttagaccggccgattccaccatctaccagacgacaaaccgccaaagaacttcactgtaactttgacaaaatgaaaacagcctagagagggacgaggacgacgggtccgtggttaattattggtgcgcgagatagaattagtacgactctaacaaggtagacgtagggtgtaactgtattg

SEQ ID NO: 372081 - DNA, 557 bp, Homo sapiens
  misc_feature: GZ8MTXP02IJQYZ.15.67.G01.1.454.CMB.2.raw
  modified_base (344)..(344): a, c, t, g, unknown or other
  modified_base (417)..(417): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcacccttagaagttattggatgacctgggtccgccaggctccaggggaagggctggagtgggtggccaanataaacaaagacggaagtacaagaaaaaccctatagtgactctgtgacgggccgattccaccatctaccaganacaaacgcaagaattcactgtatttgacaaatgaaacagcctaggaagagggacgaaggacgacggccgtaggtacttaagttgtgcgacgagagtgatagtacgacgtatacgaagtagacgtaggtagtatgattcgg

SEQ ID NO: 372082 - DNA, 664 bp, Homo sapiens
  misc_feature: GZ8MTXP02JU6XN.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcgttggtccgagggcccgggggggtccctggacgactctcctgtgcagtctctggattccacccttagaagttattggatgaccgtggtccgccgaggctccgaggggaacgggcgtggggtagtggggtcggaccaaaacgaaacgtaaaacgaaaggaaacgggtaagtaccgaaaagtaaaaaaccctgtaggtacgtaacttcgtaggttacggaccggtccgtaacttccacccagtcctaccgaagacgacaaaccgaccaaagtaactctacttacgttatttacgaacttaaatacgaaaccgacgacctaggaaggagggacggaacgggacgacggtaccgttagttattagttgtagcggtacgaggtataggtacgtaaggtacgtacctactacgtaagtacgacgtaggggtagttagaggtacgtttg

SEQ ID NO: 372083 - DNA, 712 bp, Homo sapiens
  misc_feature: GZ8MTXP02GJ0Y1.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtcctgagactctcctgtgcagtctcgtggattcacccttagaagttattggatcgaccgtggtcccgccaggctaccgaggggaaggggctggaggtgggtcggccaaacaataaaacaaaaggacggaaagtacgaaagaaaaaacctataggtacggacttcgtaggttacggaaccggggtccgtaatttacccaacccgtacttcccgtacccaaaggaaacggaaaccaaacccggacccaaaacggtaaactttaacccacgttagttaatttacggaactaaaagtacgaaaacgtacgacccgtagaacgggaacgggacgggaacggaaaccggaccgggtaccggttaggttaaacgtttaaggtttagtcgggccggacgggtagaagttacggtaagttaagtacgaaccttactaaccgtaaggtaacgtacgtagggtaggtaacgtagtacgtttagg

SEQ ID NO: 372084 - DNA, 667 bp, Homo sapiens
  misc_feature: GZ8MTXP02FZ2U2.15.67.G01.1.454.CMB.2.raw
  modified_base (444)..(444): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgagggcccgggggggtccctggagactctcctgtgcagtctcgtggtattccaacccttagtaagttattggatgacctgggtccgccaggctccgaggggaaggggctgggaggtggggtggacccaaacgaataaaacgaaaaggacggaaagtacaaagaaaaacctagtaggtagactcgtgtacggaccgggcccgaattccgaaccctntacctaccgagaacgaaccaaaccgacccaaagtaacttacaactgttaatttagaacaaaagtacgaaactacgaccgttaggaaggacgggacgggaacggaaacccggacgggacccgttaggttaatttaggtggtcgccggtacggagtagtagtacgtaaggtaactaactcgttaacgaaggtacggacgtagggtaggttacgtagtacgtttgg

SEQ ID NO: 372085 - DNA, 771 bp, Homo sapiens
  misc_feature: GZ8MTXP02F9D74.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctggagactctcctgtgcagtctctggattcaccttagaagttattggatgaccgtgggtccgccgaggctccgaggggaaggggcgtggaggtggggtggaccaaacgaagtaaaaccaaaaggaacgggaaagtacgaaacggaaaaaaaccttagtaggtacgggaacttccgttaggtacgggaccggggcccgtaagtttcccaaacccgtacttcctaccccgaaaggaaacgaaccaaaacccgaacccgaaaacggtaaactttaccgtaaaccttcggttaaatttttacgggaacctaaaaattacggaaaactacgacccgttacggaagggaacggggacgggaagggaacccggtaaccggggaccgttaggttaagtttaacgttagggttgacccggtacggaaggaaagttacggtaaagttaaggtaacggaacctttaccgttaaaccgaaggggtttaacgaccggtaaagggggttcggtttaaaacggtaggttaaccgtttagggg

SEQ ID NO: 372086 - DNA, 675 bp, Homo sapiens
  misc_feature: GZ8MTXP02GEVKA.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagaagttatggatgaccgtgggtccgccaggctccgaggggagggctggaggtgggtggccaacgataaaacgaaagacggaagtacaaagaaaaacctagtagtaggaactcgtaggtacggaccgggtccgaatttaccgaccctactcctaccgaagaacgaaccaaaccgacccaaaaggtaaacttaccgaacttacggttaatttacggaacctaaaagttacgaaaactacggacccgttaggaaacgggaggggaccgggaagggaacccgaaccggggtcccgttaggttaatttagttggtcgccggtacgaaggtatacggaaagttagtacgtaactccgttaacgaaggttacgacgtaggggtggtaactggtaactttgg

SEQ ID NO: 372087 - DNA, 543 bp, Homo sapiens
  misc_feature: GZ8MTXP02JG4LA.15.67.G01.1.454.CMB.2.raw
  modified_base (376)..(376): a, c, t, g, unknown or other
  modified_base (385)..(385): a, c, t, g, unknown or other
  modified_base (447)..(447): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagagttattggatgacctgggtccgccaggctccgaggggaaggggctggaggtgggtggccaacataaacaaagacggaagtacaagaaaacctntgtgactcngtgacggcgattcaccatctcagagacaacgccaagattcactgtatttgacaaatgaaacngcctaggacgagggcggaaggaccgacggccgtgttagttattgtgcgcgagatgatagtagactcaacgaagtaagtcgagggtgtagtgagttg

SEQ ID NO: 372088 - DNA, 580 bp, Homo sapiens
  misc_feature: GZ8MTXP02GFSAG.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagttatggatgaccgtgggtccgccaggctccgaggggaacggggctgggagtggggtggaccaaacataaaacgaaagaaggaagtacaaagaaaaacctagtgaggactcgtgtagacggcgatcacctatctccagagaacaacgacccaaagaattcactgttaattgacaaatagaaacagcctagaagacggacggaaggaaccgacgggaccgttaggtaattagtgtggaccgtacgagatagatagtacgactctaacgaagtacgacgtaggtagtaagtgtattag

SEQ ID NO: 372089 - DNA, 542 bp, Homo sapiens
  misc_feature: GZ8MTXP02FNWY9.15.67.G01.1.454.CMB.2.raw
  modified_base (484)..(484): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtccctgagactctcctgtgcagtctctggattcacccttagaagttattggatgacctgggtccgccaggctccgaggggaagggctgggagtggggtggccaaacataaaacaaaggacggaagtacaagaaaaaccctatgtggactctgtgacggccgattcaccatctcagagacaacgcaagaatcactgtattgacaaatgaacagctgagagcgaggacacggccgtagtacttatagngtcgacgagatgaatacgtagactctaacgaagttacgagtaggtggtatcggtattg

SEQ ID NO: 372090 - DNA, 555 bp, Homo sapiens
  misc_feature: GZ8MTXP02GR6HO.15.67.G01.1.454.CMB.2.raw
  modified_base (349)..(349): a, c, t, g, unknown or other
  modified_base (383)..(383): a, c, t, g, unknown or other
  modified_base (390)..(390): a, c, t, g, unknown or other
  modified_base (417)..(417): a, c, t, g, unknown or other
  modified_base (434)..(434): a, c, t, g, unknown or other
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagttatggatgacctgggtccgccaggctccgaggggaagggcgtgggaggtggggtggaccaanaataaacgaaagacggaagtacaagaaaaacctngtgactngtagaccggcattcaccatcaccaganacaacgccaaagactanactagtatttgactaaatagaaacacgcctaggagagggtagacggacgacggcgtagtattgtagtgcgtgagatagagtacgtagacctntaacgaagtagagtaggtgtatgatttgg

SEQ ID NO: 372091 - DNA, 751 bp, Homo sapiens
  misc_feature: GZ8MTXP02JWYBG.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggcgtgggaggtggggtcggacccaaacgaataaaacgaaaaggaaccgggaaagtaccgaaaggaaaaaaccctataggtagggaacctcgttaggtaggaaccggggtcccgaacgtttccaaccctaacgttccctacccgaaacggaaacgaaacccgaaaacccggaccccgtaaaaggaaactttacccaaaccgtttaggttaaatttttacggaactaaaaacgttagaaaaccaggacccgttaggaaggaacggggcgggaacgggaacgaccggggtacccggttaggtaactttaagtttggtcgggtccggtaccggaaggagtttaggaacgttaaaggttaacggtaaccttaaccgttaacgtaacgggtaaggtaccgtagggggtaggttaaagttaggtaacgtttcgg

SEQ ID NO: 372092 - DNA, 580 bp, Homo sapiens
  misc_feature: GZ8MTXP02G5ERB.15.67.G01.1.454.CMB.2.raw
  modified_base (534)..(534): a, c, t, g, unknown or other
  modified_base (538)..(538): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccagggcccgggggggtccctggagactctcctgtgcagtctctggattcacccttagaagttattggatgacctgggtccgccaggctccgaggggaaggggctgggaggtgggtcgaccaacataaaacaaagaacggaagtacaagaaaaacctagtgtaggactctagtacgacgggcctatccacctatctccagacgacaaccgacaaagaattccatgtatttagacaaatgaaacagaccgtagagaggacgaagggaccgacggaccgtagttaacgttagttagtcgcgcggtaagngtanaagtacgtagactctaagaagtagacaggtagtatggacttg

SEQ ID NO: 372093 - DNA, 607 bp, Homo sapiens
  misc_feature: GZ8MTXP02JMZH5.15.67.G01.1.454.CMB.2.raw
  modified_base (301)..(301): a, c, t, g, unknown or other
  modified_base (375)..(375): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggattcaccttagagttatgatgacctggccncaggctccgagggaagggctggagtggggtggaccaaacgataaaacaaagacggaaagtacaagaaaaacctntagtaggactcgtagtacggacggccgaattccacctagtcctacccagacgaccaaacggaccaaagaacttaccacttagtaatttagacaaagtagaaacacgacctaggaaggacgggacgaacgggaccgacgggaccgttagtacgttagttgtcgcggacgagtatacggagttaagtacgacttacgtactaaggtagacgtaggtaggtacgtacggtattgg

SEQ ID NO: 372094 - DNA, 659 bp, Homo sapiens
  misc_feature: GZ8MTXP02G90VG.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggaggtcgtgggggaggcttggtccgacgggcccgggggggtccctggacgacctctcctgtgcagtctcgtggattcacccttagaagttattggatgaccgtgggtcccgccgaggcctccgagggggaaggggcgtaggggaggtggggtcggacccaaaacgaataaaaacgaaaggaacggaaagtacgaaagtaaaaaacctagtaggtaggacttcgtaggttacggaccgggtccgtaattcccaacctagtccctaccgaagacgaacaaacccgaccaaaagtaacttactaactagttactttaggaactaaaagtacgaaacgacgtacctaggaaggacggacgggaaggaccgacggccgtagttattagtttgcgcgtaggagagtacgtaagtagtacactactacgaagtagacgtaggtgtaacgtgtagtttgg

SEQ ID NO: 372095 - DNA, 769 bp, Homo sapiens
  misc_feature: GZ8MTXP02G9BLP.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattccacccttagaagttattggatgaccgtgggtccgccaggctaccgaggggaggggcgtgggaggtggggtcggaccaaacaagtaaacaaaggaacggaaagtacgaaagaaaaacctagtaggtaggtacctcgtgtacgaccggggtccgtaagtttaccaccctatccgtaccgaaggaaacgaaccaaaccggacccaaaacgtaaactttccctaacttacggttaacgttttacggaaactaaaacgtacgtaaaaccgacgtacccgttagggaacggaacggggaccgggaaacggggaacccggaaccggggtacccggtttaggtttaaacgtttaaggtttgggtacggtacccggtaacgggaacggtaggttacgggtaaagttaacgggttaaacggtaaccttaccgttaaaccggtaaaggtttaacgggaccggttaaacgggggttaggttaaacggttacggtaaacgtttttcgggg

SEQ ID NO: 372096 - DNA, 616 bp, Homo sapiens
  misc_feature: GZ8MTXP02JIMQ5.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgagggcccgggggggtccctggagactctcctgtgcagtctcgtggattccacccttagaagtttattggatgacctgggtccgcaggctccgaggggaaggggctgggaggtggggtcggacccaaaacataaaacgaaaggaccggaaagtaccaaagaaaaaaccctgtaggtaggaaccttcgtaggtacggaccggggcccgtaatttccaaccctatcctaccgagaacgacaaaccgaccaaagaattcactgttatttgacaaatagaaacagcctaggagagggacgaaggaccgacggcgtagtattagttgtgcgtacgagtagtagtataagtacgaactctaacgaagtagacgtagggtgtagtcgtagtttgg

SEQ ID NO: 372097 - DNA, 568 bp, Homo sapiens
  misc_feature: GZ8MTXP02G6Z0Y.15.67.G01.1.454.CMB.2.raw
  modified_base (437)..(437): a, c, t, g, unknown or other
  modified_base (443)..(443): a, c, t, g, unknown or other
  modified_base (445)..(445): a, c, t, g, unknown or other
  modified_base (469)..(469): a, c, t, g, unknown or other
  modified_base (513)..(513): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtcagtgtgaggtgcattggtggagtcgtgggggaggcttggtccgaggccggggggggtccctgagactctcctgtgcagtctctggtattcacccttagtaaagttattgggatgaccgtgggtcccgcctaaggctccgaggggaaggggctgggagtgggcggccaaagtaataaaacgaaaagaacggaaagtacaaagtaaaaaacccctatagtggaacctgtgcggaacgggcctattccaccattcncgagananaaacgcaaagtatcatgtattcanaatagaacagcagagagagagacgacgacgtagtataatgtggngagagagtagatagtacgtactactagaagagtacgtaggtaggtagtagtagtg

SEQ ID NO: 372098 - DNA, 561 bp, Homo sapiens
  misc_feature: GZ8MTXP02J1DHO.15.67.G01.1.454.CMB.2.raw
  modified_base (455)..(455): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagagttattggatgacctggtccgccaggctccaggggaggggctggaggtgggtggccaaacataaacaaagacgaagtcaagaaaaacctagtgtggactctggtgacggccgattccacatctccagacgacaacgaccaaagaactcactgttatttgactaaatcgaaanacgcctagagagggacggaggacacgggccgtagtattagttagtagcgcgagagtggtaaataggttacgactacgtacaagtacgacgaggtagtatagattcg

SEQ ID NO: 372099 - DNA, 723 bp, Homo sapiens
  misc_feature: GZ8MTXP02HTKDH.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattccacccttagaagttatggatcgaccgtggtccgccgaggctccgaaggggagggcgtgggaggtggggtacggaccaaacaaagtaaaacgaaaggaacggaaagtacgaaaagtaaaaaccctagtaggtacggacttcgtaggtacggaccggccgtaattaccacctaatcctaccaacgaacgaacaaaccgaacccaaagtaacttacaacttagttaagtttacgaaactaaaagtacgaaaccacggtacctaggaaggacgggaccggaacgggaaccgtaacgggacccggtttagttaaacgtttagtttggacggaccggacggtaagacgttaaggtaacgtaaaggtttaacggaaccgtttacccaaacggtaaggtttaacccgggaacgtttaacggggggtaactttaacgggtttacgtaaagttttacgggg

SEQ ID NO: 372100 - DNA, 748 bp, Homo sapiens
  misc_feature: GZ8MTXP02GA29K.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgtttattttagaaggtgtccagtgtgaggtgcacttggtggagtcgtgggggagcttggtccgaggccggggggtccctgagactctcctgtgcagtctctggtacttccacccttagaagttattgggatcggaccgtcgggtccgccgaggccgtccgaggggaacggggcgtaggggaggtggggtcggacccaaacgaaataaaacgaaaagggacggaaagtacaaagtaaaaaccctagtggtaggactcgttggtacggaccggggtccgtaattccaaccctagtccctaccgaaggaaacgaaccgaaacccgacccaaaagtaaactttacccgtaacgttaccgtttaaagttttacggaacctaaaaagttacgaaaaccgtacggtaccccgttagggaacggaacgggggaccgggaacggggaaacccggaccggggtaccgggtttaggtttaacgtttagttgggttacgacccgggtacggtaaggtagttacggaagttaaagtacgtaacttccgtaaagaacgttaggacgtaggggttaggtagttacgtacggtttacg

SEQ ID NO: 372101 - DNA, 584 bp, Homo sapiens
  misc_feature: GZ8MTXP02IVWJ0.15.67.G01.1.454.CMB.2.raw
  modified_base (264)..(264): a, c, t, g, unknown or other
  modified_base (550)..(550): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcngtctctggattcacccttagaagttatggatgacctgggtccgccaggctccgaggggaagggctgggagtgggtggaccaacagtaaaacaaagaacggaagtacaagaaaaacctgtgtaggactcgtaggtacgacgggcctagttaccaccgtatctaccaggaacgacgaaccgaccaaagaattacactgttatttgacaaatgaaacagccctaggacgagggcggaaggacgacggtccgtgtaacttgttagtgcgacgagatgaatagtacgactntaacgaagtagacgtaggtaggtactaggatttg

SEQ ID NO: 372102 - DNA, 542 bp, Homo sapiens
  misc_feature: GZ8MTXP02FVKTI.15.67.G01.1.454.CMB.2.raw
  modified_base (303)..(303): a, c, t, g, unknown or other
  modified_base (319)..(319): a, c, t, g, unknown or other
  modified_base (428)..(428): a, c, t, g, unknown or other
  modified_base (468)..(468): a, c, t, g, unknown or other
  modified_base (511)..(511): a, c, t, g, unknown or other
  modified_base (534)..(534): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccctagagttattggatgacctgggtccncagctcagggagggcnggagtgggtgccaacataaaacaaagacggaagtacaagaaaaaccctatgtaggactcgtgtagacggccgattcaccatctccagagacaacgccaaagattcactntatttgacaaatgaaacagcctagagaggacgaggaaccncggcgtggtattatgtgcgacgagatggatacggtagtacctntaacaaggtagctagggtgtaanggatttcg

SEQ ID NO: 372103 - DNA, 787 bp, Homo sapiens
  misc_feature: GZ8MTXP02FOGDM.15.67.G01.1.454.CMB.2.raw
  modified_base (307)..(307): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggagtcgtgggggagcttggtccgagggccggggggtccctgagactctcctgtgcagtctctggattcacccttagaagttattggatcgaccgtgggtccnccaggctccgaggggacgggctgggaggtgggtacggaccaaacaataaaacgaaaggaccggaagtacgaaaggaaaaaaccctgtgtggaaccttcgtaggtagggaccgggcctaattaccaaccctattccgacccgaaggaaacggaaccaaaacccggaccctaaaaggtaaactttacctaaccgttaggtttaattttacggaacctaaaaagttacgggaaaaccaaccggtacccgttacgggaagggaacgggggacccggggtaaacgggaacccggtaacccgggggttaccccggtttaaggttttaacgtttaaccgttttaggggtcggtacccgggtacggaaaggggttaactacgggtaaaacgttaagggttaaccggtaaccttaccgtttaaaccgaacgggtttaacggacggtaacgggggttagggttaacgttacggggtaactttttcccggg

SEQ ID NO: 372104 - DNA, 616 bp, Homo sapiens
  misc_feature: GZ8MTXP02G096K.15.67.G01.1.454.CMB.2.raw
  modified_base (299)..(299): a, c, t, g, unknown or other
  modified_base (311)..(311): a, c, t, g, unknown or other
  modified_base (392)..(392): a, c, t, g, unknown or other
  modified_base (563)..(563): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccgagggcccgggggggtccctggagacctctcctgtgcagtctctggattccaccttagaagttattggntgacctggtccnccaggctccgaggggagggctgggagtgggtggaccaacgaataaaacaaaggaacggaaagtacgaaagaaaaaaccctntggtaggactacgtaggtacgaccgggccgtaattccacctacgtcctaccgaaaggaacgaaccaaaccgacccaaaagtaaactttccaacgttgttaatttgaactaaaagtacgaaacagcctagaggacggacggaggaccgacggtcgtgtaacttatgtagcgnagatagatacgacgactctaagaagtacgacgtaggttagtatagtacgtttg

SEQ ID NO: 372105 - DNA, 620 bp, Homo sapiens
  misc_feature: GZ8MTXP02F9HQB.15.67.G01.1.454.CMB.2.raw
  modified_base (265)..(265): a, c, t, g, unknown or other
  modified_base (343)..(343): a, c, t, g, unknown or other
  modified_base (399)..(399): a, c, t, g, unknown or other
  modified_base (421)..(421): a, c, t, g, unknown or other
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgtttattttagaaggtgtccagtgtgaggtgcacttggtggagtcgtgggggaggtcgttggtccgagggccggggggtccctgagactctcctgtgcngtctcgtggacttcacccttagaagttatggatgaccgtgggtccgcaggctccgaggggaagggctgggaggtgggnggaccaaagataaaacgaaaggacggaaagtacaaaggaaaaacctgtgtagactntgtagacggcgattcaccatcnccaagacacaaaccgacaaagattacactagttattagacaaatagtaaacagaccgtagaagacggacgaaggaccgacgggtccgtagttagtttagttaggngccggacgaggtaagttgaaagttaagtaccgtaacgttaccgttaaacgaagttaaaccgggacggttagggtacgttaagtagtacgtttag

SEQ ID NO: 372106 - DNA, 645 bp, Homo sapiens
  misc_feature: GZ8MTXP02ID20A.15.67.G01.1.454.CMB.2.raw
  modified_base (344)..(344): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaaggtgtccagtgtgaggtgcacttgggtggagtcgtgggggaggcttggtccgagggccgggggggtccctggagactctcctgtgcagtctctggattccaccttagaagttatggatgaccgtggtccgcaggctccgaggggagggctggagtgggtgaccaaanaataaaacgaaaggaacggaagtacaaaaggaaaaaccctagtaggtaggactcgttaggacggaaccggggtccctaattcccaacctactcctaccaagaaccgacgaaaccgacctaaagaaacttcccaacttaggtttaatttagaaactaaaagtaacgaacgaacgacgtacggaggacggacggaacggacgacggtacgttagttagttagttagtacgacggacgtagtagtagtagtaacgtacgtacgtacgtacgtaagtacggtacgtaggtaggtagtagtagtag

SEQ ID NO: 372107 - DNA, 649 bp, Homo sapiens
  misc_feature: GZ8MTXP02J2KGJ.15.67.G01.1.454.CMB.2.raw
  modified_base (347)..(347): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggccgggggggtccctgagactctcctgtgcagtctctggattcacccttagaagttattggatgacctgggtccgccaggctccgaggggaaggggctggaggtgggtagccaaanaataaaaccaaaggaacggaaagtaccaaagaaaaaaccctgtagtcggactctggtacgaaccgggccgtaattccgacctaatccaccagacgaacaaccgaccaaagaaattcactgtaactttagactaaatagaaacagccgtaggaagaggacggaaggtaccgaacgggtccgtaggttaattaagttgtcgacgcggaaaagtagtaggtaaacgttaacggtagaaaacttcccgtaaacgaaggtttacgacggtaaggggtttaggtaaacgttcgggtaattttaccggg

SEQ ID NO: 372108 - DNA, 757 bp, Homo sapiens
  misc_feature: GZ8MTXP02GAPSS.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcaccttagagttatgatgacctggtccgccaggctcgaggggagggctggagtgggtcgaccaacaataaaacaaagacggaaagtacaaagaaaaacctagtaggtaggacttcgtaggtgaccgggcccgtaattcccaaccctacttccgtacccgaagaacgaacccaaacccgacccgtaaaagtaaactttaccgtaaaccgttggtttaatttttacggaacctaaaaagttacgaaaacgacggtacccgttagggaacggaacggggacccgggaaagggaaaccccggtaccggggtaccccggtttagggtttaactttaaggtttcggtacgggtccggaaccgggtaaggtaagttacgggtaaagttaaacggggtttaaacgaacccggtttaccttaaaccggtaaagggtttacccggacggggttaaaacggggttggggtttaaaacgttcggttaacggtttcggg

SEQ ID NO: 372109 - DNA, 575 bp, Homo sapiens
  misc_feature: GZ8MTXP02J3LQU.15.67.G01.1.454.CMB.2.raw
  modified_base (348)..(348): a, c, t, g, unknown or other
  modified_base (454)..(454): a, c, t, g, unknown or other
  modified_base (515)..(515): a, c, t, g, unknown or other
  modified_base (524)..(524): a, c, t, g, unknown or other
  modified_base (535)..(535): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggaggcttggtccgagggcccgggggggtccctggagactctcctgtgcagtctctggattccacccttagaagttattggatgacctggtccgcaggcctccgaggggagggctggaggtgggtgccaaanataaaacgaaagaacggaaagtcaaagaaaaaccctgtgcggaactcgtgtacgaccggccgtaattccacatcctaccagacgaccaaacgacccaaagtaactnactagtattagacaaatgaacagcctaggagaggcgaaggacacggcgtagtattgttagngcgcgagangtaataggtanacctctaacgaagtagacgtaggtagtatacggtatttgg

SEQ ID NO: 372110 - DNA, 602 bp, Homo sapiens
  misc_feature: GZ8MTXP02HQWY0.15.67.G01.1.454.CMB.2.raw
  modified_base (304)..(304): a, c, t, g, unknown or other
  modified_base (467)..(467): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccnccaggctccgaggggaaggggctgggagtggggtggaccaacgaataaaacaaaggacggaagtacaagaaaaaccctatgtaggactctgtgaccggccgtattccacctatctaccagacgacaacgccaaagattcacttgtatttgactaaatgaaacngtcgtagagaggacggaggaccgacggtcgttagttattagtggtcgcgtacggtaagtagtacgtaaagttaggtaaccgtaccttacgaacgtaaggtacgacggtaggggttaggtacgttacggtatttgg

SEQ ID NO: 372111 - DNA, 609 bp, Homo sapiens
  misc_feature: GZ8MTXP02JOXQX.15.67.G01.1.454.CMB.2.raw
  modified_base (483)..(483): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagactctcctgtgcagtctctggattcacccttagaagttattggatcgacctgggtccgccaggcctccgaggggaaggggcgtgggaggtggggtggccaaacgaataaaacgaaaggaacggaagtaccaaaggaaaaacctagtgtacggaactctggtacggacggccgtattccgaccatcctccagacgacaaccgaccaagaatcactgtatttgacaaatcgaaacngaccgtgaggaggacggaggaaccgacggccgtagtacttagtcgtgccgtacgagtagtagaacgtagttaacgtactacccgttaacgaaggtacgtacggtaggttggtattacggagtttgg

SEQ ID NO: 372112 - DNA, 577 bp, Homo sapiens
  misc_feature: GZ8MTXP02FOFHA.15.67.G01.1.454.CMB.2.raw
  modified_base (421)..(421): a, c, t, g, unknown or other
  modified_base (464)..(464): a, c, t, g, unknown or other
  modified_base (470)..(470): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctgagactctcctgtgcagtctctggattcacccttagaagttattggatgacctgggtccgccaggctccgaggggaaggggctggaggtgggtggccaaagataaacaaagacgaagtcaagaaaaacctatgtaggactctagtgacgggccgattacaccatctccagacanaaaccgaccaaagtaacttacactgttaatttagacaaaagtnaaaacncgacctaggaagacggcggaaggaccgaacggccgtgtaattatggtgcgacgagatacgagttagagactctaaagaagttacgcgtaaggtggtatggatttcgg

SEQ ID NO: 372113 - DNA, 742 bp, Homo sapiens
  misc_feature: GZ8MTXP02I6OPW.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggccggggggtcctggagctctcctgtgcagtctctggattcaccttagagttatggatgacctgggtccgcgaggctccgaggggaagggctgggaggtggggtcgaccaaacgaataaaacaaaggaacggaaagtacgaaaagaaaaacccttagtggtaggacttcgtaggttacgaaccgggccgtaagttaccaaccctattctacccgaaagaacgaaccgaaaccggacccaaaaggtaactttaccgaactttaggttaactttacggaactaaaaagttcgaaaaccgtacgggacccgttaggggaacggtaacggggaccggggaaccgggaaacccgtacccgggggtacccggtttagggttaacttttaacggttggtaacgggtcggaccggtaaaggtagttacggggtaaaagttacggtaacggtaacccttcgttaaaaccgaagggtttacggaccggttagggggttagtacgttacggggtaacgttttgg

SEQ ID NO: 372114 - DNA, 551 bp, Homo sapiens
  misc_feature: GZ8MTXP02GUA4J.15.67.G01.1.454.CMB.2.raw
  modified_base (301)..(301): a, c, t, g, unknown or other
  modified_base (335)..(335): a, c, t, g, unknown or other
  modified_base (367)..(367): a, c, t, g, unknown or other
  modified_base (472)..(472): a, c, t, g, unknown or other
  modified_base (504)..(504): a, c, t, g, unknown or other
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccaggccggggggtccctgagactctcctgtgcagtctctggattcaccttagagttatggatgacctggtccncaggctccaggggagggctggagtggtggccaanataaacaaagacggaatcgaagaaaaaccctntagtggaactctgtgacggccgattccgaccatctccagagacaaacgccaaagatcactgtatttgacaaatcgaaacagacctagagagggacgaaggaaccncgggaccgtggtaattatggtgcgtcggaagntgaagtacgtagactcctanaagtagacgaggtagtaatcgagtttg

SEQ ID NO: 372115 - DNA, 550 bp, Homo sapiens
  misc_feature: GZ8MTXP02I4NAO.15.67.G01.1.454.CMB.2.raw
  modified_base (372)..(372): a, c, t, g, unknown or other
  modified_base (502)..(502): a, c, t, g, unknown or other
  modified_base (507)..(507): a, c, t, g, unknown or other
  modified_base (525)..(525): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgagtgcacttggtggagtcgtgggggaggcttggtccaggcccggggggtcctggagactctcctgtgtagtctcgtggattcacccttagaagttattggatgacctgggtcccgcgagctccgagggaggggctggagtggtgccaacataaacaaagacggaaagtcaagtaaaaactntgtagactctgtcgaacgccgattcaaccagtctaccgagacacaacgaccaaagtactcacgtgtatttgactaaatagaaccagccgtagacgagacgaggaacgcggaccgtgtagttagtgtgcgnaggangagtagacactccgtaanagtaagcgaggtgtatgtatgttcg

SEQ ID NO: 372116 - DNA, 536 bp, Homo sapiens
  misc_feature: GZ8MTXP02FWO7O.15.67.G01.1.454.CMB.2.raw
  modified_base (341)..(341): a, c, t, g, unknown or other
  modified_base (374)..(374): a, c, t, g, unknown or other
  modified_base (402)..(402): a, c, t, g, unknown or other
  modified_base (515)..(515): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattccacccttagaagttattggatgacctgggtccgccaggctccaggggagggctggagtgggtgccaanataaacgaaagacggaagtacaagaaaaacctntgtgactctgtgacggcgatcaccatcncagagacacgcaaagattcactgtatttgacaaatgaaacagcctgaagaggacgagactacggctgtattatgtgcgtacgagatgatagtacgactacgtaacaaggtaanacgtaggtgtagtagactttg

SEQ ID NO: 372117 - DNA, 561 bp, Homo sapiens
  misc_feature: GZ8MTXP02GDHY1.15.67.G01.1.454.CMB.2.raw
  modified_base (307)..(307): a, c, t, g, unknown or other
  modified_base (387)..(387): a, c, t, g, unknown or other
  modified_base (397)..(397): a, c, t, g, unknown or other
  modified_base (421)..(421): a, c, t, g, unknown or other
  modified_base (509)..(509): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattgggatgacctggggtccnccgaggctcccgaggggaaggggctgggaggtggggtcggccaaacataaaacgaaagacggaagtcaagaaaaaccctntgtggactcngtgacgccgattcaccatcaccanagacaaccgccaaagaattcacgtgttaatttgacaaaatgaaacagcctgagaggcgaggaccacggtccgtgtatatcgtgacggngagatagagtagtagtactactacgaagtagacgtaggtaggtagtagtatg

SEQ ID NO: 372118 - DNA, 557 bp, Homo sapiens
  misc_feature: GZ8MTXP02F8FNY.15.67.G01.1.454.CMB.2.raw
  modified_base (473)..(473): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggtattcacccttagaagttattggatgaccgtgggtcccgccaggctccgaggggaggggctgggaggtggggtggaccaaacaataaaacgaaaggaacggaaagtacgaaagaaaaacctatggtaggaactctaggtagaccgggccgattccaccatctccagagacaacgcaaagattcactgtattgacaaatgaaacngctagagaggcgagaccgacggcgtagtagttatgtgcgcgagatgagtagtacgactgtacaagtagcgaggtgtatgagttg

SEQ ID NO: 372119 - DNA, 562 bp, Homo sapiens
  misc_feature: GZ8MTXP02FMQ1G.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttattggatgacctgggtccgccaggctccgaggggaaggggctgggagtggggtggaccaaacataaaacaaagacggaaagtacaagaaaaaacctatgtggaactctagtagacgggccattccaccatctaccagagacaacgccaaagaattcactgttatttagacaaatgaaacagcctagagaggacgaggaccacggcgtgtattatgtgcgacgagatagagtagtacgactctaacaaggtacgacgtaggtggttatggtacttagg

SEQ ID NO: 372120 - DNA, 557 bp, Homo sapiens
  misc_feature: GZ8MTXP02I7TYC.15.67.G01.1.454.CMB.2.raw
  modified_base (377)..(377): a, c, t, g, unknown or other
  modified_base (412)..(412): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggcccgggggggtccctgagactctcctgtgcagtctctggattcacccttagaagttattggatgacctgggtccgccaggctccgaggggaagggctggagtgggtggaccaacataaacaaagacggaagtacaagaaaacctntgtagactctgtgacggcattcaccatctccaganacaacgcaagattcacttgtatttgacaaatgaaacagcctaggacgaggcgaacggacgacggtccgtgttacttagtgtagtcgcgagatgagtagtacgactacctaagaaggttacgacgtaggtaggtagtgtaagtttg

SEQ ID NO: 372121 - DNA, 684 bp, Homo sapiens
  misc_feature: GZ8MTXP02GS3BT.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttattggatacgacgtcggtccgcgacgctccggaggggacgggcgtggaggtggggtcgacgaaacaaacgtaaaacgaaaggaaacggaagacgaaaacgaaaaaccgtagtaggtacgacttcgtggtaacggaccgggacgtactacccaaccgacttcctaccgagaacgaacgaaacccgacaaagtaacttactacgttagtttacgttacgtaacaaagttacgaaacgtaccgtaccgtaggaacgggacggaacggaaacgggaccgtaacccggggaccggttaaggttaactttaagttgggtacgaccggacggagtagtaggtaagttagtaacggacttaccgtaagtaagtacggagtagggttacgtagtggtagtttacgg

SEQ ID NO: 372122 - DNA, 625 bp, Homo sapiens
  misc_feature: GZ8MTXP02GJF9B.15.67.G01.1.454.CMB.2.raw
  modified_base (578)..(578): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttgggtggagtcgtggggggaggtcttggtccgagggcccgggggggtccctggagactctcctgtgcagtctcgtggattcacccttagaagttattggatgaccgtgggtccgccaggctaccgaggggaaggggctgggaggtggggtcggaccaaacaataaaacgaaaaggacggaaagtacgaaagaaaaacctagtaggtaggactcgtaggttacgaaccgggtccgaatttacccaaccataccctccaaagaacgaaccgaaaccgcccaaaagtaacttacctactagtttatttagaacctaaaagtagaaaacacgaccgtagaacggaggacggaaggaccgacggtcgtagtattatgtgcgnggagatagattagacgactcacgaagtagcgaggtgtatgagtttcg

SEQ ID NO: 372123 - DNA, 875 bp, Homo sapiens
  misc_feature: GZ8MTXP02I5NTN.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttgggtggagtcgtgggggagcgttggtccgagggccggggggtccctggagactctcctgtgcagtctcgtggacttcaacccttagaagttattggatgaccgtcggccgccgaggcctcgaggggaaggggcgtagggaggtgggtggacccaaacaagtaaaacgaaaaggacggaaagtacaaagaaaaaccttagtgtaggtactcgtaggtacgaccggccgtaacttccaaccgtattaccgtacccgaaagaaaccgaaccgtaaacccgacccgaaaagtaaactttacccctaacgttagtttaaacggtttttacgaaacctaaaaaagtttacgggtaaaaacccaacgggttaaccccgttacgggaagggtaaaccgggggtaccgggtaaaacccgggggtaaacccgggaacccgggggttaaccccgggtttaacgggttttaaaacgtttttaaacggggttttagggggtttcggggtaaccgggaaacccgggttaaaacgggttaaacggttaaacgggaaaacggttttaaaggttaaaccgggggtttaaacccttaccggtttaaaaaccggttaaggggtaaaccgggttaacgggttaacgggggtttaaggttaaaacggggtttcggttaaaacgggtttttcggg

SEQ ID NO: 372124 - DNA, 605 bp, Homo sapiens
  misc_feature: GZ8MTXP02FUVQ6.15.67.G01.1.454.CMB.2.raw
  modified_base (384)..(384): a, c, t, g, unknown or other
  modified_base (423)..(423): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggctttgggtccaggcccgggggggtccctgagactctcctgtgcagtctctggattcacccttagaagttattggatgacctgggtccgccaggctaccgaggggaaggggctggaggtggggtggccaacaataaaacgaaagacggaagtacaagaaaacctntgaggactctgtagacggccgattcaccattcaccaganacaaacgccaaagaattcactgttaatttagactaaaatgaaacgagcccgtaggaagacgggacgggaaggaaccgacgggtacccgtagggttaactttaagttggtagcggacggaagagtacgaagtacgtaagaccttaataccgaaggtagacgtagggtggtaatggactttagg

SEQ ID NO: 372125 - DNA, 573 bp, Homo sapiens
  misc_feature: GZ8MTXP02JFD8B.15.67.G01.1.454.CMB.2.raw
  modified_base (333)..(333): a, c, t, g, unknown or other
  modified_base (510)..(510): a, c, t, g, unknown or other
  modified_base (548)..(548): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttatggatgacctggtccgcaggctccgaggggagggctggagtgggnggccaacataaaacaaagacggaagtacaagaaaaacctatgtggactcgtggtagacgggccgaattcgacctatcctccgaagaacgaccaaacgcccgaaagtacttcactgtaatttgaactaaatgaaacagcctggaagaggacggaggacgacggacgtgtattagttgngcggtacggagagtagaagtacgtacgactactaacgngtacgcaggggtgtaatggatttgg

SEQ ID NO: 372126 - DNA, 543 bp, Homo sapiens
  misc_feature: GZ8MTXP02HD9VA.15.67.G01.1.454.CMB.2.raw
  modified_base (373)..(373): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtccctgagactctcctgtgcagtctctggattcacccttagaagttattggatgacctggtccgcaggctccgaggggagggctgggagtgggtggccaaacataaaacaaagacggaagtcaaagaaaaacctntagtaggactctgagacggccgattcaccatcgtccagagacaacgaccaaagacttacactagtatttgacaaatgaaacagcctgagagcgagacacggctagtattatgtagcagagatagactagacgaactctaagaagtaagacgtaggtagtacgtgtagtcg

SEQ ID NO: 372127 - DNA, 522 bp, Homo sapiens
  misc_feature: GZ8MTXP02HL3QH.15.67.G01.1.454.CMB.2.raw
  modified_base (301)..(301): a, c, t, g, unknown or other
  modified_base (331)..(331): a, c, t, g, unknown or other
  modified_base (369)..(369): a, c, t, g, unknown or other
  modified_base (399)..(399): a, c, t, g, unknown or other
  modified_base (401)..(401): a, c, t, g, unknown or other
  modified_base (477)..(477): a, c, t, g, unknown or other
  modified_base (495)..(495): a, c, t, g, unknown or other
  modified_base (503)..(503): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggagcttggtccaggccgggggggtcctgagactctcctgtgcagtctctggattcacccttagaagttatggatgacctgggtccncaggctccgaggggagggctgggagtgggngaccaaacataaaacaaagacggaatcaagaaaaactntgtggactctgtgacggcatcacatcacananacaacgcaaagatcactgtatttgacaaatgaaacagacctgagaggcgagacgtacggcgtagtattatgtgcgngagatgatagtagactanacaagtanacgaggtggtatgtaatcg

SEQ ID NO: 372128 - DNA, 635 bp, Homo sapiens
  misc_feature: GZ8MTXP02GPIMT.15.67.G01.1.454.CMB.2.raw
  modified_base (348)..(348): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggccagggccgggggggtccctggagactctcctgtgcagtctctggattcacccttagaagttattggatgacctgggtccgccaggctccgagggaaggggctggaggtgggtggaccaaanataaaaccgaaaggacggaaagtacaaagaaaaactagtagtaggaactcgtagtacggaacggccgtattccgaacctacttacctacccgaagaacgaacctaaaccgacccaaagtaaacttacaacttaggttatttagaactaaaatacgaaacaggacctaggagaacgggcgaaggggaccgacggccggttagttaacgtttagtggtgcgacggaagagttgaacgtaagtacgactacgtactagaacgtagagggttgtagtagacgttgtttacg

SEQ ID NO: 372129 - DNA, 588 bp, Homo sapiens
  misc_feature: GZ8MTXP02IAK3R.15.67.G01.1.454.CMB.2.raw
  modified_base (265)..(265): a, c, t, g, unknown or other
  modified_base (311)..(311): a, c, t, g, unknown or other
  modified_base (536)..(536): a, c, t, g, unknown or other
  modified_base (541)..(541): a, c, t, g, unknown or other
  modified_base (571)..(571): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtcccgagggcccgggggggttccctgagactctcctgtgcngtctctggattcacccttagaagttattggatgacccgtgggtccnccaggctccgaggggaaggggctgggaggtgggtaggccaaacagtaaaacaaaggaacggaagtacaaagtaaaaaccctagtgtaggactcgtagtagacgggcctagttaccaccattctccagaacacaaaccgaccaaagtaactcactgttactttgaacctaaagtcgaaatacgcctagagacggacgaggaccgacggcgtagtattgttgtgcgngtagntaggtaacagtacgactctaagaagtacgngtaggtaggatgaattg

SEQ ID NO: 372130 - DNA, 537 bp, Homo sapiens
  misc_feature: GZ8MTXP02FSIIX.15.67.G01.1.454.CMB.2.raw
  modified_base (418)..(418): a, c, t, g, unknown or other
  modified_base (437)..(437): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggccgggggggttccctgagactctcctgtgcagtctctggattcacccttagaagttattggatgacctggtccgccaggctccaggggaaggggctggaggtgggtggccaacataaaacgaaaagacggaagtcaagaaaaaccctatgtggactctgtgaccggccgattcaccatctccaganacaacgccaagaatcactntattgcaaatgaacagcctgagaggcgaggacacggccgtgtatatgtcgcgcgagatgatagtacgactctacaagtagacgaggtagtatagacttag

SEQ ID NO: 372131 - DNA, 612 bp, Homo sapiens
  misc_feature: GZ8MTXP02IZ45S.15.67.G01.1.454.CMB.2.raw
  modified_base (307)..(307): a, c, t, g, unknown or other
  modified_base (329)..(329): a, c, t, g, unknown or other
  modified_base (386)..(386): a, c, t, g, unknown or other
  modified_base (465)..(465): a, c, t, g, unknown or other
  modified_base (490)..(490): a, c, t, g, unknown or other
tcagtctacgtagccacgaccggtgctcgatttagagtatacatattgggtttgaggtctcagagaggagccttagccctggactccaaggcccttttccacttggtgatcagcactgagcacagaggactcaccatggagttggggctgagctgggttttccttgttgttattttagaaggtgtccagtgtgagtgcacgttggtggagtcgtgggggagcttggtccagggcccggggggtccctgagactctcctgtgcagtctcgtggtattcacccttagaagttatggatgacctggtccncaggctaccgaggggaagggcnggacggtgggtcgaccaaacaagtaaaacgaaagaacgaagtacaaagaaaaacctntgagaactctaggtacgacggccgtattaccacctataccctacaagaacgaacaaacgaaccaaagtaacttacactntaagtttagacaaaatggaaaaccncgacgaggaagacggacggaacggacgtacggtacgtagttattagttgacgacgtacggagtagtagtaaatacgtacgtaacgtacgtaagaagtagacgtaggtagtagtagtattacg

SEQ ID NO: 372132 - DNA, 561 bp, Homo sapiens
  misc_feature: GZ8MTXP02HR2FI.15.67.G01.1.454.CMB.2.raw
  modified_base (350)..(350): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccgggggggtccctggagactctcctgtgcagtctctggattcacccttagaagttatggatgacctgggtccgccaggctccgaggggaaggggctgggagtggggtggccaaanataaaacaaagacggaagtcaagaaaaaccctagtgtaggactctgtgacggccgattccaccatctaccagacgacaacgccaaagaattcactgtatttgcaaatgaacagcctagagaggcgaggacacggcgtgtattagtgtgcgtcgagatagattagacgacttactacaaggttagacgtagggtaggttataggtactttgg

SEQ ID NO: 372133 - DNA, 799 bp, Homo sapiens
  misc_feature: GZ8MTXP02II0UC.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttatttagaggtgtccagtgtgaggtgcacttggtggagtcgtgggggaggcttggtccgaggcccggggggtccctggagactctcctgtgcagtctctggattcacccttagaagttatggatgacctgggtcccgccgaggctccgaggggaaggggctgggaggtggggtcggccaaacgataaaacgaaaaggaacgggaaagtacgaaagaaaaaacccgttagtaggtacggaaccttcgtaggttacgggaacccggggtcccgtaaagtttacccaaacccgtaacttacccttacccccgaaaggaaacgaaacccaaaacccgggaacccccaaaaggaaaaccgtttaccctaaacccgtttacgttaaagtttttacggaacctaaaaagttacgaaaaccgacgtaccccgttaaggaacggaaggggacccgggaaaggggtaacccgaaccggggtaccccgggtttaggttaacgtttaacgtttagggtcggacccggtacgggaaggtacgttacggtaaaggttaaggtttaacgggaacccctttagtaaaaccgtaaggttaacggtaccgtaggggttacgggtttaacgttacggtaagttttaccggg

SEQ ID NO: 372134 - DNA, 590 bp, Homo sapiens
  misc_feature: GZ8MTXP02HZWQX.15.67.G01.1.454.CMB.2.raw
  modified_base (479)..(479): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtgggggaggcgttggtccgaggcccgggggggtccctgagactctcctgtgcagtctctggattccaccttagaagttattggatgacctgggtccgccaggctccgaggggaaggggctgggaggtggggtcggaccaaacagtaaaacaaaggaacggaagtcaaagaaaaacctatgtaggactcgttaggtgaccgggccgtaattccacctactcctaccagacacaaacgcaaagaatcactgttattgacaaatgaaacngctggagaggcgaggacgacggcgttagtatttagtgtacggcgcgtaagagtagaaatagtaacgactttacgaacaaggttagacgtagggtagttataggtactttgg

SEQ ID NO: 372135 - DNA, 597 bp, Homo sapiens
  misc_feature: GZ8MTXP02I9Z8Y.15.67.G01.1.454.CMB.2.raw
  modified_base (392)..(392): a, c, t, g, unknown or other
  modified_base (572)..(572): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagaactcaccatggagttggggctgagctgggttttccttgttgttattttagaaggtgtccagtgtgaggtgcacttggtggagtcgtgggggaggtcttggtccgaggcccgggggggtccctgagactctcctgtgcagtctctggattcacccttagaagttattggatgacctgggtcccgccaggctccgaggggaaggggctgggaggtggggtggaccaaacgaataaaacgaaagaacgggaagtacaaagaaaaacctntaggtaggacttcgtagtacggtaccgggcctaattccaccatctaccgagacgacaaacgaccaaagtaacttcactgtatttagactaaaatgaaacacgacctaggagaggaccggaaggacctacgggccgtaggttaattgttgtgccgacgagatgaatacgagactcctaagngtaacgagtaggtagtagtgtactg

SEQ ID NO: 372136 - DNA, 608 bp, Homo sapiens
  misc_feature: GZ8MTXP02JFPOL.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggcccgggggggtccctggagactctcctgtgcagtctctggattcacccttagaagttattggatgacctggtccgcaggctccgaggggaaggggcgtgggaggtggggtggaccaaacaataaaacgaaaggacggaaagtacaaagaaaaacctagtagtaggacctcgtaggttacggaccggggtccgtaatttccgaaccctatccctacccgaagaacgaacaaaccgaccaaagtaacttacacttgtatttagacaaaatgaaacagcctaggagaggacggagacgacggcgtagtattagttgtagcgacgagatagatagtacgactctaacgaagtagacgtagggtagtagttagagtttgg

SEQ ID NO: 372137 - DNA, 583 bp, Homo sapiens
  misc_feature: GZ8MTXP02I3MYR.15.67.G01.1.454.CMB.2.raw
  modified_base (488)..(488): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccgaggcccggggggtccctgagactctcctgtgcagtctctggattcacccttagagttattggatgacctgggtccgccgaggctccgaggggaagggcgtgggaggtggggtggacccaaacaactaaaacgaaaggacggaagtacaagaaaaacctgtagtgactctaggtagaccggcgatccaccatctaccagacgacaaccgaccaaagtactacactgttatttgacaaatcgaaacagcctagagagggnggaacgacgacggtcgtagtattagttgcgcgacgagagtgaatagacgtactcttaaacgaagtacggtagtaggtagtagtacgtagtttacg

SEQ ID NO: 372138 - DNA, 682 bp, Homo sapiens
  misc_feature: GZ8MTXP02F67EO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgagggcccggggggtccctgagactctcctgtgcagtctcgtggtattccacccttagaagttattggatgaccgtggtcccgccgaggcctccgaggggaagggcgtgggaggtggggtcggaccaaaacgaataaaacgaaaaggaacggaagtacgaaagaaaaaacctagtaggtagactcgtaggtacggaccgggccgtaattaccgaccctattcctacccgaagaacgaaccaaacccggacccaaaagtaaacttcctaacttaggtttaactttagaaccaaaaatcgtaaaacgacgaccgtaggaagagggaccgggaaaggacccgacgggaccgttagttaattagttgtcggccgacggtagtagttaggaaagttaggtaaactacgtactaaacgtaaggtaacggagtaaggtagggttagttagacgttttagg

SEQ ID NO: 372139 - DNA, 572 bp, Homo sapiens
  misc_feature: GZ8MTXP02FMB2Z.15.67.G01.1.454.CMB.2.raw
  modified_base (352)..(352): a, c, t, g, unknown or other
  modified_base (452)..(452): a, c, t, g, unknown or other
  modified_base (461)..(461): a, c, t, g, unknown or other
  modified_base (521)..(521): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgagggccgggggggtccctggagactctcctgtgcagtctctggattcacccttagaagttattggatgacctgggtcccgccaggctccgaggggaggggctgggagtggggtggccaaanataaaacaaaggacggaaagtacaaagaaaaacctatgtaggactctggtagaccggccgattccaccatctacagagacaacgaccaaagattcacgtnttattcganaaatgaaacagcctaggagagggacgaaggaccgacgggccgtgttaacttagtgtgcgngagatgaagtagacgtactctaataacgtagacgagggtgtatgtacttgg

SEQ ID NO: 372140 - DNA, 673 bp, Homo sapiens
  misc_feature: GZ8MTXP02I2O5B.15.67.G01.1.454.CMB.2.raw
  modified_base (300)..(300): a, c, t, g, unknown or other
  modified_base (319)..(319): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttgggtccaggccggggggtccctgagactctcctgtgcagtctctggattcacctagattatggatgacctggtccncaggctcgaggggagggcnggagtgggtggaccaacaataaacaaaggacgaagtacaaagaaaaacctagtagtggaacttcgtaggtacggaccgggccgtaagtttcaacttcaactttcgtacccaggaacgaaaccaacgacccaaaggtaactttacaacttagttactttagacctaaaagttacgaaacgtaggacccgttaggacggacggggaaccggaacgggaaccgtaacccggggacccggtttaggttaacgtttaaagggtttggttacggaccgggtacggaaggtacgtaaggtaacgttaaggtaaacgtacctacggttaacaggttaggacgtagggtttagtagtcgtaag

SEQ ID NO: 372141 - DNA, 592 bp, Homo sapiens
  misc_feature: GZ8MTXP02HVTY6.15.67.G01.1.454.CMB.2.raw
  modified_base (345)..(345): a, c, t, g, unknown or other
  modified_base (534)..(534): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagttcgtgggggaggcttggtccaggccgggggggtccctgagactctcctgtgcagtctctggattcacccttagaagttattggatcgacctgggtcccgccaggcctccgaggggagggctggagtgggtgccaanataaacgaaagacggaaagtcaaagaaaaacctagtgtaggacttcgtggtacgacggccgtaattccaaccgatcctaccaagacgaaaccaaaccgacccaaagaaattcctaacttagttaatttgaacaaaatgaaacagaccgtagagaggcggaggacgaccggcgtagtattagtgtagcgngtagagtgtatacgtagacctcgaacgtaagtacgacgtagggtggtaatcgtagttg

SEQ ID NO: 372142 - DNA, 596 bp, Homo sapiens
  misc_feature: GZ8MTXP02HK58D.15.67.G01.1.454.CMB.2.raw
  modified_base (304)..(304): a, c, t, g, unknown or other
  modified_base (330)..(330): a, c, t, g, unknown or other
  modified_base (336)..(336): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccaggcccgggggggtccctgagactctcctgtgcagtctctggattcacccttagaagttatggatgactggtccncaggctcaggggagggctggagtggngccaanaataaacgaaagacgaagtacaagaaaaacctagtgtacggacttcgtggtagaccgggccgtaattccgaccctaatcctaccagaacgaacgaacccgacaaagtaacttctaactagttatttgaactaaatagaaacagtacctagaaggacgcgggaaggaaccgacgggccgtagtacttaagttgtcgcgtacgagagtacgtagtaagtacgtacctgttaacgaagtagtacgtaggtggtactgtatttg

SEQ ID NO: 372143 - DNA, 578 bp, Homo sapiens
  misc_feature: GZ8MTXP02ISALD.15.67.G01.1.454.CMB.2.raw
  modified_base (394)..(394): a, c, t, g, unknown or other
  modified_base (460)..(460): a, c, t, g, unknown or other
  modified_base (521)..(521): a, c, t, g, unknown or other
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtctctgagactctcctgtgcagtctctgattcaccttagaagttatgatgaccgtgggtccgccaggctccgaggggaagggcgtggagtggggcggaccaacaataaacgaaagacggaaagtacaagtaaaaactatggtggactcgttgnggaacggccgattccaccgatactccagacgaacaacgaccaaagaacttacacgttagttattanacaaattagaaacaggacctggagagggtcgaggacacggcgtgtattagtgtgtcgcganagtanagttacgaacgtacttacgaactaggtacgacgtagggtacgtagtacgtag

SEQ ID NO: 372144 - DNA, 619 bp, Homo sapiens
  misc_feature: GZ8MTXP02IRIM6.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccgaggcccggggggtccctgagactctcctgtgcagtctctggattctacccttagaagttattggatgaccgtcgggtccgccgaggctccgaggggaaggggcgtgggaggtgggtcggccaaacataaaacaaaggacggaagtacaaagaaaaacctagtgtaggactcgtgtacgaccgggcctattccacctatctccaagacgacaaaccgaccaaagaacttcacttgttaatttgacaaaatgaaacacgccgtagagacgggcggaacggaccgacggccgttagttaatttagttaggtgacgtacggagtagtaggtaataagttacgaaccttacgttaacgaaggttacgacgtaggggttgtatacggtatttcgg

SEQ ID NO: 372145 - DNA, 608 bp, Homo sapiens
  misc_feature: GZ8MTXP02G9JKU.15.67.G01.1.454.CMB.2.raw
  modified_base (301)..(301): a, c, t, g, unknown or other
  modified_base (488)..(488): a, c, t, g, unknown or other
  modified_base (549)..(549): a, c, t, g, unknown or other
  modified_base (579)..(579): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccggggggtccctgagctctcctgtgcagtctctggattcacccttagagttattggatgacctgggtccnccaggctccgaggggaagggctggaggtgggtggaccaacaataaaaccgaaaaggaccggaaagtacaaagaaaaacctgtagtaggacttctggttaggaccgggccgtaattccaaccgtattacccgtccaagtaaacgaacaaaccggacccaaaggtaaacttacactagttatttacganaaatagaaaccagcctaggaggaggacggtaaggacgaaccggtccgttagtattagttgngcgcgagatcgatacgttacgactctaacnggttaagcgagggttgtagtgtacgtttg

SEQ ID NO: 372146 - DNA, 756 bp, Homo sapiens
  misc_feature: GZ8MTXP02IEDNW.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggcgttggtccgagggcccggggggtcctggacgactctccgtgtgctagtctcgtggtacttcctaacccttaagaagtttagtggatcggaccgtgggtccccgcgtaggcctaccggaggggaacgggtcgtagggaaggtggggtacggaaccaaaacgtaaagtaaaaacgaaaggaaacggaaagtaccgaaaagtaaaaaacccgttagtaggtacgggacttcgtaggttacggacccggtacgtaactttaccaaccctaacgttcctaacccgaaggaaacgaacccgtaaaaccgaacccgaaagttaacttacgtaacgtttaggttaaactttaggaacctaaaagtaacgaaacgtacgtaccgtagggaaagggacgggaacgggaaccggaacggtaaccgggtaccgttagtttaagttaacgtttggacggccgtaacggagtagagttaaacgtagtaacgtaccttacgtaaccgtaaagtcgtaacgtacgggtagttagaccgtttaagttcgg

SEQ ID NO: 372147 - DNA, 541 bp, Homo sapiens
  misc_feature: GZ8MTXP02FXORW.15.67.G01.1.454.CMB.2.raw
  modified_base (402)..(402): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcaccctagagttatggatgacctggtccgccaggctcaggggaagggctggagtgggtggccaacataaacgaaagacggaatacaagaaaacctatgagactctgtgacggcgattcaccatctcaganacaacgccaaagatcactgtatttgacaaatgaaacacgccagagagcggagaccacggtcctgttattagttgtgcgacgagagtaggatacggtacaactcgtaacaagtacgacgaggttaggtatagtagtttcg

SEQ ID NO: 372148 - DNA, 686 bp, Homo sapiens
  misc_feature: GZ8MTXP02IMDCI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcgtgggggaggcttggtccgaggcccggggggtcctgagactcctcctgtgcagtctgtggattccacccttagaagttagttggatcgaccgtgggtcccgccgaggcctccggaaggggaaggggcgtggggaggtggggtcggaccaaactaaataaaaacgaaaaggaaacggaaagtaacaaaagtaaaaacctagtagtacggacttcgtaggtacgaaccggccgtaattaccaccctatctacccaagaacgaacgaaaccgaccgaaaagtaacttactaacgttgttaaatttacgaaactaaaataacgaaaacgaacgaccgtaaggaagggaacgggaccgggaaggaacccgacggtacccggttagtaatttaggttagtcggacgtcggaaagtagtaacgtaaagttacggtacgtaactacgtaaacgaagtacgaggtaggtagtacgtagtagtttg

SEQ ID NO: 372149 - DNA, 635 bp, Homo sapiens
  misc_feature: GZ8MTXP02F57DT.15.67.G01.1.454.CMB.2.raw
  modified_base (267)..(267): a, c, t, g, unknown or other
  modified_base (387)..(387): a, c, t, g, unknown or other
  modified_base (597)..(597): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggaggcttggtccgagggcccgggggggtccctggagactctccgtgtgcngtctctggattccaccttagaagttattggatgacctgggtcccgccaggctccgaggggaagggctgggagtgggtggaccaaacataaaacgaaagacggaatacaaagaaaaacctntgtagactctggtagacggccattcacctatctacagaacgaacaaaccgaccaaagtaacttcaacttgttaatttacgaactaaaagtagaaaaccaggtacccgtaggaaaggaccggggacggaaacgggaaccgaaccgggggtacccgtttaggtaaacgtttatcgggtacggcggacgagagtagataaaggtacgtacctntaacgaagtacgagtacgggtggttaatggtaatttgg

SEQ ID NO: 372150 - DNA, 692 bp, Homo sapiens
  misc_feature: GZ8MTXP02HI60E.15.67.G01.1.454.CMB.2.raw
  modified_base (619)..(619): a, c, t, g, unknown or other
tcagtctacgtagccacgaccggtgctcgatttagagtatacatattgggtttgaggtctcagagaggagccttagcccctggactccaaggcctttccacttggtgatcagcactgagcacagaggactcaccatggagttggggctgagctgggttttccttgttgttattttagaaggtgtccagtgtgaggtgcacgttggtggagtcgtgggggaggtcgttggtccgaggcccggggggtccctgagactctcctgtgcagtctcgtgattccaccttagaagttagtggatcgaccgtgggtcccgcgacggcctaccggaggggaacgggtctaggggtaggtggggtcggacccaaaacgaaacgtaaaacgaaaaggaacggaaagtacaaaacgaaaaacctagtagtacggaactcgtaggtacgaccgggtccgtaaacttccgaactacttaccaacccgagaaaccgaaccaaaccgaacccgaaagtaacttaccctaacgttagttaatttacgaactaaaagttacgaaaacgtacggaccgtagggaacggaacgggacgaacgggaaccgtaccgggtacgttaagttagttagttggngccggaacgagtagtacgtaagtaagtacgtactacgagtaagtacggacggtacggtagtagtcgtagttcg

SEQ ID NO: 372151 - DNA, 595 bp, Homo sapiens
  misc_feature: GZ8MTXP02IPG4O.15.67.G01.1.454.CMB.2.raw
  modified_base (407)..(407): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggtccctgagactctcctgtgcagtctctggattcacccttagaagttattggatgacctgggtccgccaggctccgaggggaggggctggaggtgggtgccaacataaaacaaagacggaagtacaagaaaacctgtgtggactcgtgtagaccgggccattccaccntctcagagaccaacgaccaaagacttacacttagttatttagaacaaatgaaacagtcctaggagacgggacgaacggaccgacgggtccgtagttaactttagttggtgccggtacggagtagtagtaaagttagtacgtactacgtaacgtaaggtacgcggtagggttggtacgtaggtatttgg

SEQ ID NO: 372152 - DNA, 612 bp, Homo sapiens
  misc_feature: GZ8MTXP02JUD8Z.15.67.G01.1.454.CMB.2.raw
  modified_base (315)..(315): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcgttggtccgagggcccggggggtccctggacgactctcctgtgcagtctctggtacttccacccttagaagttattggatgaccgtgggtccnccgaggctccgaggggaggggcgtgggaggtgggtggaccaaacgaataaaacaaaggaacggaagtacaaagaaaaaacctgtagtaggactcgtagtagaccggccgattccaccatcctaccgaagacgaccaaacgaccaaagaattcactgtatttagactaaatagaaacagccgtagaggaggcggaaggaccgacgggtaccgttgttaatttagttggtcgacgtacggaagtatacgtaagtaagtacgtacctcttaacgaagtagcgtaggtgtactggatttgg

SEQ ID NO: 372153 - DNA, 625 bp, Homo sapiens
  misc_feature: GZ8MTXP02FU01V.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagaagttattggatgacctgggtccgccaggctccgaggggaaggggctgggaggtggggtggacccaaacaataaaacgaaaaggaacgggaaagtacaaagaaaaacctgtaggtaggacttcgtgtaggaccgggcctaattccgaaccctattcctacccgaagaacgaaccaaaccggacccaaaagtaactttacaacttgttaatttgaactaaaagtgaaacgacgcctaggaggaggacggaaggacgaccggacgtagttagttagttgtacggcgacgtagagtagaattagtacgactacttacgaagtacgacgtagggtagtagtagatttgg

SEQ ID NO: 372154 - DNA, 821 bp, Homo sapiens
  misc_feature: GZ8MTXP02GYSWO.15.67.G01.1.454.CMB.2.raw
  modified_base (320)..(320): a, c, t, g, unknown or other
  modified_base (353)..(353): a, c, t, g, unknown or other
  modified_base (387)..(387): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgctacgttggtggagtcggtgggggaggtcgttgggtcccgagggcccgggggggttccctggacgtacttcctcctgtgctagtctctggattcacccttagaagttattggatgactggtccncaggctcgaggggagggctggagtggtgccaanaataaaacgaagacggaagtacaagaaaaacctntgtacggactcgtaggttacggaccgggtcccgtagttacccaaacccgtactttccgacccgaagggaaacgaacccgaaaacccgacccgaaaaggttaaacttacctaacgttacggttttaattttacgggaaccctaaaaagttacgggtaaaacccgaacggttaccccgttaaaggggacggggtaaacggggacgggtaaaccggggaaacccggaacccgggggtaccccggtttagggtttaaaacttttggtttaacggtcgggcccgggttaacgggaaaggtttaaaccgtacgggttaaaattaaaccggggttaacggttaacccctttaacgttaaaaccggtaaggtttaaacccgggacgggtttaaaacgggggtttacggtttaaaagtttcgggttaaaaggtttttaccggg

SEQ ID NO: 372155 - DNA, 624 bp, Homo sapiens
  misc_feature: GZ8MTXP02JC96X.15.67.G01.1.454.CMB.2.raw
  modified_base (349)..(349): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggagcttggtccaggccgggggggtccctgagactctcctgtgcagtctctggattcacccttagaagttattggatgacctgggtccgccaggcctccgaggggtaagggctgggagtggggtggcccaaaanaataaacgaaaggacggtaatacaaagaaaactagtggtacggactgtgaggaccgggcctacttaccaacctagtctaccgaaggaacgaacgaaaccgaccgaaagtaacttacgacttgttatttacgaataaatagaaacgacgtacgtaggagagggacggaacggacggaccggaccggtacgttagttagttagtgtcggacggaggagtagtaagtaagtaacgtacgtacgtacgtaacgtagtacgtaggtaggtagtagtagtg

SEQ ID NO: 372156 - DNA, 541 bp, Homo sapiens
  misc_feature: GZ8MTXP02I779X.15.67.G01.1.454.CMB.2.raw
  modified_base (373)..(373): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagttatggatgactggtccgcaggctccagggaagggctggagtgggtggccaaacataaaacaaagacggaagtacaagaaaaaacctntagtgactctgtagacgcgatcaccatctcagagacaaacgcaaagaatcaactgtatttgacaaaatgaaacacgacctagagaggacgaagacacggctagtacttatgtgcgacgagatagataaggtacactacaacgaagtacgacgtaggtgtagtgtactg

SEQ ID NO: 372157 - DNA, 624 bp, Homo sapiens
  misc_feature: GZ8MTXP02HI39O.15.67.G01.1.454.CMB.2.raw
  modified_base (351)..(351): a, c, t, g, unknown or other
  modified_base (443)..(443): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggcttgggtccagggcccgggggggtccctggagactctcctgtgcagtctcgtggattccacccttagaagttatggatgacctggtccgcaggctccgaggggaagggctggaggtgggtggaccaaanaataaaacaaaggaacggaaagtacaaaggaaaaacctagtgtacggaactgtaggtacggacggccgattaccaccaactctacccagaanacaaacgaccaaagaactacactagtatttagacaaagtagaaacagacctaggaaggaggacggaaggacgaaccgggccggtagttacgtttaattggagacccggtcgaggaatggtaaataccgggtaagtacttaccgaacgtaagacgtagagggttagggatacgtaagtttcg

SEQ ID NO: 372158 - DNA, 583 bp, Homo sapiens
  misc_feature: GZ8MTXP02G24QU.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggtccctgagactctcctgtgcagtctctggattcacccttagaagttattggatgacctgggtccgccaggctccgaggggaaggggctgggagtgggtggccaaacataaacaaaggacggaagtacaaggaaaaaaccctagtagtaggactctagtgaccgggccgattcaccatctccagacgacaaacgccaaagaacttcgactgtatttgactaaatgaaactagacctgaagagggacgaggacgacgggccgtagtattagttgtgcgacgagagtagtagtagtacgacctcgtaacgtaagttagacgtaggttaggtaatggtaacgtttgg

SEQ ID NO: 372159 - DNA, 808 bp, Homo sapiens
  misc_feature: GZ8MTXP02GIWMO.15.67.G01.1.454.CMB.2.raw
  modified_base (355)..(355): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggaggtcgtgggggaggtcgttgggtcccgagggcccgggggggtccctggagacctcctcctgtgcagtctcgtggattccacccttagaagttattggatgactgggtccgccaggctccgaggggagggctgggagtgggtggaccaanaagtaaaacaaagacggaatacgaaagaaaaacctgtagtaggacttcgtggttacggaccgggtccgtaagtttaccaaccgtactcctacctaaaggaacgaaaccaaaacccggacccgaaaaggtaaactttacccgtaaacgttcgtttaaattttacggaacctaaaaagttacgaaaaaccgtacggtaccccgttagggaaacggaacgggggaccgggaaacggggaaacccgtaacccgggggtacccgggtttaaggtttaaacgtttttaaggtttcgggtttacgggaccgggtaccgggtaaaagggttaacgtttaacgggtaaacggtttaaaggtaaacgggtaaccctttaaccggttaaaccgaaagggtttaaccgggacggttaaacgggggtttagggtttaaaacgtccgggtttaacgtttttacgggg

SEQ ID NO: 372160 - DNA, 568 bp, Homo sapiens
  misc_feature: GZ8MTXP02GGOFR.15.67.G01.1.454.CMB.2.raw
  modified_base (311)..(311): a, c, t, g, unknown or other
  modified_base (393)..(393): a, c, t, g, unknown or other
  modified_base (396)..(396): a, c, t, g, unknown or other
  modified_base (412)..(412): a, c, t, g, unknown or other
  modified_base (415)..(415): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggtcttggtccgagggccggggggtccctgagactctcctgtgcagtctcgtggattcacccttagaagttattggatgaccgtgggtcccncaggcctccgaggggaggctggaggtgggtggccaaacataaaacgaaagacggaagtacaaagaaaaacctgtgtagactntgngacggcatcaccatcncanacgacaacgacaaagattcactgtatttgacaaatgaaacagccgtagaggacggaggagaccgacggccgtaggtattatgtagcgtacgagtatagtaagtagtaacgactacgttaacgaagtagacgtaggtggtaatggtactttagg

SEQ ID NO: 372161 - DNA, 723 bp, Homo sapiens
  misc_feature: GZ8MTXP02FXH5V.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggaggtcggtggggggaggcgttgggtccgagggtcccgggggggtccctggacgactctcctgtgctagtctctggtattccacccttagaagttattggatgaccgtgggtcccgcaggctaccggaggggaaggggctagggaggtggggtcggacccaaaactaataaaacgaaaaggaccggaaagtacaaagtaaaaaccctgtaggtacggaacttcgtaggtacggaacccggggccgtaacttaccaacccctaattcccgtaaccgaacggaaacgaacccgaaaacccgacccgaaaaagtaactttaaccaacttaggtttaattttaggaacctaaaagttacgaaaaccgacgtaccgtaggaaaggacggggacgggaacggtaaccggaccgggtcccggttagtttaaagtttgttagggtggccgtacggaggtattacggaattaaagtacgaactataaccgaaggttaaggcgtagggtaggtataggtatttcgg

SEQ ID NO: 372162 - DNA, 893 bp, Homo sapiens
  misc_feature: GZ8MTXP02I3468.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcttggtccgaggcccggggggtccctggagactctcctgtgcagtctctggattcaccttagagttattggatgaccgtgggtccgccgaggcctaccgagggggaacggggcgtaggggaggtggggtacgggacccaaacgaataaaaccgaaaggaaccgggtaaagtacaaaggaaaaaacctagtaggtacggaccttagtacggttacggaaccgggggtcccgtaacgtttacccaaccccgtaacttccgtacccgaaaggaacgaaacccgaaacccgaacccgtaaaaggtaaactttacccgtaaacctttaggtttaaacgtttttacggaaacccgtaaaaaagttacggaaaaaccgtaaaccggttacccccgtttaaaggggtaaacggggaacgggggtaacccggggtaaaacgggggaaacccccgggtaaacccgggggttacccgggttaaacggttttaaactttttaaagggtttccgggtacggggtaccccgggtaacgggtaaacggggttaaagttaaacggggtaaaacgttaaagggtttaaccggaaaaccgttttaccgtaaaaccggtaaggttaaacggggtaaccggttaaagggggtttacgggtttaaaaggttacggggttaacgtttttaacgggg

SEQ ID NO: 372163 - DNA, 785 bp, Homo sapiens
  misc_feature: GZ8MTXP02HD7EM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttcctgttgttatttagaaggtgtcagtgtgaggtgcagttggtggagtcgtgggggagcgttggtccgagggcccgggggggtccctggacgtactctcctgtgctagtctcgtggatcctacctagaagttatggatcgacgttcggaccgcgaggcctaccggaaggggaacgggcgtagggaaggttggggacggaacccaaaactaaacgtaaaaaacgaaaaggaaacggtaaagtaacgaaaaaggaaaaaaacccttgtaggtagggaaccttcgttaggtaacgggaaccgggtaccgtaaatttacccgaaaccctaacgtttaccctacccgaaagggaaaccgaaacccggaaaacccgtaacccgaaaaagtaacgtttaacctaaccgtttacgggtttaactttaggaaaccaaaagttaacggaaaacacgttaccgtaggaagggacgggtaacgggaacgaccgttaacggggccgttaagttacgtttagttgcgggcctaacggggattaaggtacgtaaaaccggttaagggtttaacgaccccgtttaaacgtaacggtaacggttaacggtacgggttacgggtagttacgtacggtttacgtgg

SEQ ID NO: 372164 - DNA, 647 bp, Homo sapiens
  misc_feature: GZ8MTXP02HSFFD.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggcccgggggggtccctggacgactctcctgtgcagtctctggattccacccttagaagttatggatgaccgtggtccgcaggctccgaggggagggcgtggaggtgggtggaccaaacaagtaaaacaaaggaaccggaaagtacgaaagaaaaaacctagtagtaggacttcgtaggtacggaccggccgtaatttccgaaccctaattcctaccaagaacgaaacccaaacgacccaaaagtaaacttaccgtaacttagttaattttacggaacctaaaagttaacgaaacacgacctaggaaggacgggacggaagacgacggccgttagtagttagttgtgcgcgagatagagtaagtacgtactactaacgtaagtaacgacgtaaggggtagtaagtgtaacgtttgg

SEQ ID NO: 372165 - DNA, 916 bp, Homo sapiens
  misc_feature: GZ8MTXP02GFU2Q.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgctacgttggtggagtcggtgggggaggtcgttgggtcccgacggggcccgggggggttccctggacgtaccgttcctccgtggtgcctagttcctcgtggtactttccaaccccgtttaagtaagtttagtttgggaattcggtaacccgtgggtcccccgaccgtacgggtaccttacccgggaaggggggtaaacggggtccgttaggggtaacggggtttcgggggtacgggaaacccccttaaaacaaaacggtttaaaaaaaacccgaaaaaacggggaaaccggggtaaaacggtttaaaccgaaaaaacggtaaaaaaaaaacccctttggttaaccgggttaaggggtaaccctttacggttacggttaacgggaaccccggggtccgttaaacgtttacccgaaacccctaagttaccccgtaacccgaaaggaaaccgaaacccgtaaaacccgtaacccgaaaaggttaaaccttaccctaaccgtttagtttaagttttaacgaacgtaaaaacgtaggtaaaacccgacgtacccgtaggaacggaacgggacggaaacggttaaccgaaccgggtacccggttaaggtttaactttaggttaaggtcggtaccgacggtaagtagtacgtaaagtaggtttaacggaccttaccgtaacgtaaggttacggacggttacggtaggttaacgtacgtacggtttcgg

SEQ ID NO: 372166 - DNA, 780 bp, Homo sapiens
  misc_feature: GZ8MTXP02H8A32.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcattggtggagtcgtgggggaggcttgggtccgaggcccgggggggtccctgacgacctctcctgtgcagtctctggacttccacccttagaagttatggatgaccgtggtccgccaggctccgaggggagggcgtgggaggtgggtcggaccaaacaagtaaaacgaaaaggacggaaagtacaaagtaaaaacctagtgtaggactcgtaggacggaccgggccgaacttccaacccgtactaccgtacccgaaaggaaccgaaaccgaaaacccggacccgtaaaagtaaacttaccctaacgttaggttaacttttaggaacctaaaaagtacggaaaacctaacggtaccccggttagggaaagggaacgggggtaccgggaaaacggggaaccccgtaacggggtacccggtttaggttaaaacgttttagtttgggttacggggccggtaaccggtaagggtaaagttacgggtaaaacgttaaagggttaacggtaaaccctttaaccgtaaaccggtaacggttaacggtacggtaacgggggtttaggtaacggtttacggtaagtttttcggg

SEQ ID NO: 372167 - DNA, 657 bp, Homo sapiens
  misc_feature: GZ8MTXP02FRHQ5.15.67.G01.1.454.CMB.2.raw
  modified_base (267)..(267): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtgggagtcggtggggggaggtcgttggtccgagggccggggggtccctgagctctcctgtgcngtctcgtggtacttcacccttagtaagttattgggatcgaccgtcgggtcccgccgaggcctccggagggggaacggggcgtggggaggtggggtcggaccaaacaataaaacgaaaggacggaagtacgaaagaaaaacctagtggacgtactcgtaggtacgaccggggcctagttaccaaccctactcctacccgaagaaacgaaccaaacccggaccaaaacgtaacttacctaactggttaatttacgactaaaatacgaaaacgacgaccgtaggaacggagggaccgggaaggaccgacggcgttagtagttagtggtgcgacgagtagtacgtatacgtagactacgtagtaagtagacgtagggtagtagtgtacgtttgg

SEQ ID NO: 372168 - DNA, 599 bp, Homo sapiens
  misc_feature: GZ8MTXP02I5K85.15.67.G01.1.454.CMB.2.raw
  modified_base (344)..(344): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtggaggtgcacttggtggagtcgtgggggaggcgttggtccgaggccgggggggtccctgagactctcctgtgcagtctctggattcacccttagagttatggatgacctggtccgccaggctccgagggaaggggctggagtgggtggaccaaanataaaacaaaggaacggaagtacaaagaaaaacctagtgtacggactgtagttagaccgggccgtaattaccgaccagttcctaccgaagaacgaaccaaccgaccaaagtaacttcacttagtactttagactaaaatagaaacacgcctaggagacgggacggaagaccgacgggccgtagtattagtggtcgacgcgagatagaagtagacgactctaacgaagtacgacgaggttagtaacgtggtatttg

SEQ ID NO: 372169 - DNA, 581 bp, Homo sapiens
  misc_feature: GZ8MTXP02F3U6V.15.67.G01.1.454.CMB.2.raw
  modified_base (540)..(540): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcttggtccgagggccggggggtccctggagactctcctgtgcagtctctggattcacccttagagttatggatgacctgggtcccgcaggctccgaggggaagggctggaggtgggtggaccaaacaataaaacgaaaggacggaaagtacaaaagaaaaacctagtgtaggactcgtagtacgaccggggctattcacccagtcaccagagacaaaccgacaaagaattcacttgtaatttacgacaaaatgaaacagcctaggagaggacgaaggacccgacgggtcgtagttattagtcggtagcgtagagtagngtaatagacacgtcaagaagtacgagtaggtgatgactttg

SEQ ID NO: 372170 - DNA, 602 bp, Homo sapiens
  misc_feature: GZ8MTXP02H5WP2.15.67.G01.1.454.CMB.2.raw
  modified_base (541)..(541): a, c, t, g, unknown or other
  modified_base (545)..(545): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccgaggtccgggggggtccctggagacttctcctgtgcagtctctggattcacccttagaagttattggatgacctgggtccgcaggctccgaggggagggctggaggtgggtggaccaacgaataaaacgaaaggaaacggaagtacaaaggaaaaaccctagtgtaggacttcgtaggttacgaccgggccgtagttacccaacctagtaccctaccaggaaacgaacaaccgacccaaagaacttcaacttgtatttgacaaatgaaactgcctagacgaggcgaggtaccacggccttaggattagttgngcgngagatggaaactaggtacactacgtacaaggtacgacagggttagtactgaactttg

SEQ ID NO: 372171 - DNA, 563 bp, Homo sapiens
  misc_feature: GZ8MTXP02H0ES0.15.67.G01.1.454.CMB.2.raw
  modified_base (303)..(303): a, c, t, g, unknown or other
  modified_base (318)..(318): a, c, t, g, unknown or other
  modified_base (320)..(320): a, c, t, g, unknown or other
  modified_base (323)..(323): a, c, t, g, unknown or other
  modified_base (326)..(326): a, c, t, g, unknown or other
  modified_base (329)..(329): a, c, t, g, unknown or other
  modified_base (335)..(335): a, c, t, g, unknown or other
  modified_base (339)..(339): a, c, t, g, unknown or other
  modified_base (343)..(343): a, c, t, g, unknown or other
  modified_base (357)..(357): a, c, t, g, unknown or other
  modified_base (361)..(361): a, c, t, g, unknown or other
  modified_base (440)..(440): a, c, t, g, unknown or other
  modified_base (449)..(449): a, c, t, g, unknown or other
  modified_base (452)..(452): a, c, t, g, unknown or other
  modified_base (454)..(454): a, c, t, g, unknown or other
tcagtctacgtagccacgaccggtgctcgatttagagtatacatattgggttttgaggtctcagagaggagccttagccctggactccaaggcctttccacttggtgatcagcactgagcacagaggactcaccatggagttggggctgagctgggttttcttgttgttattttagaaggtgtcagtgtgaggtgcattggtggagtcgtgggggaggcttggtccaggccgggggggtcctgagactctcctgtgcagtctctggattcaccttagaagttatggatgacctggccgcaggntccgaggggaagggngnggnggnggngacaanaaanaaanaaagaaagaagaanaaanaaaactaatagtagactgtagtagacgacgtactacacactacacagaacaacaaacaacaaagaatactatatattanaacaataanaananacagagagagagacgacgacgtagtattagttagtgacgacgaagagtagtaagtaacgtaacgtactaactaacgtaagtaacgaacgtaggtaggtagtagtagtag

SEQ ID NO: 372172 - DNA, 661 bp, Homo sapiens
  misc_feature: GZ8MTXP02FQ3EI.15.67.G01.1.454.CMB.2.raw
  modified_base (379)..(379): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctgggtccgccaggctccgaggggaaggggctgggagtggggtggaccaacataaacgaaagacggaagtacaagaaaaacctntagtaggactctaggtagacgggccgattcaccatcctccaagacgaacaaaccggacccaaagtaaattaccaacttacggttaatttttggacctaaaaattggaaaacctaacggacccttagggaggaacggggaccgggaagggaaccgaccggggcccggttaggttaaactttagttacggtggtaccggacggtaaggagtagaaagtaacggtaagtaaccttcgttaacgaaggttaacgaccgtaggggttaggttaatggtaagtttcgg

SEQ ID NO: 372173 - DNA, 616 bp, Homo sapiens
  misc_feature: GZ8MTXP02HP7UR.15.67.G01.1.454.CMB.2.raw
  modified_base (266)..(266): a, c, t, g, unknown or other
  modified_base (347)..(347): a, c, t, g, unknown or other
  modified_base (392)..(392): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagttcgtgggggaggcttggtccgagggccgggggggtccctggagactctcctgtgcngtctcgtggattcacccttagaattatggatgacctggtcccgcaggctccgaggggagggctgggagtgggtggccaaanaataaaacgaaagacggaagtacaaagaaaaaccctgagtgactntgtagaccggcgtattcaccatcctacagaacgacaaccgaccaaagtaatccgattgttatttgaactaaatcgaaagcgtaccgagaacggagggacggaaggtaccgacggggtaccgttagtagtttaagttgtggaccggtagagaagtaggtaacgttaggtaactccttaattaaccgaagttaagacgtaggggttaggtataggttaactttggg

SEQ ID NO: 372174 - DNA, 620 bp, Homo sapiens
  misc_feature: GZ8MTXP02IWSC5.15.67.G01.1.454.CMB.2.raw
  modified_base (590)..(590): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggcccgggggggtccctgagactctcctgtgcagtctctggattcacccttagagttattggatgaccgtgggtccgccgaggctccgaggggaaggggctgggagtggggtcggaccaacaataaaacaaaggacggaaagtacaaagaaaaacctatgtggactcgtgtcgaaccggccgtaattccgacctactctacccgaagaacgaaccaaaccgaccaaagaaacttacaactgttatttgaaccaaaagttgaaacaggcctaggacggagggacggaacgggaccacggggtccgttagttagtttagttggtgccggacgaggtatagtagtaacgtacgacttcctaanaagttagacgtagggtagtatcgtatttgg

SEQ ID NO: 372175 - DNA, 604 bp, Homo sapiens
  misc_feature: GZ8MTXP02ILNHM.15.67.G01.1.454.CMB.2.raw
  modified_base (474)..(474): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggtattcacccttagaagttattggatcggacctgggtcccgccaggctccgaggggaagggctgggagtggggtggccaaacataaaacaaagaacggaagtacaagaaaaacctgtagtggactctgtgacggccgattaccacattcaccagaagacaaacgaccaaagaacttcaactgtttatttagacaaaatgaaaacncgacgtggagagggacggaacggaccgacgggtacgttagtaatttagttgtgcggacgagtagtaggaacgtagtaacgtactaccgtaagaaggttaacggacggtaggtacggtaataggtacgttg

SEQ ID NO: 372176 - DNA, 527 bp, Homo sapiens
  misc_feature: GZ8MTXP02HNHVH.15.67.G01.1.454.CMB.2.raw
  modified_base (305)..(305): a, c, t, g, unknown or other
  modified_base (332)..(332): a, c, t, g, unknown or other
  modified_base (336)..(336): a, c, t, g, unknown or other
  modified_base (342)..(342): a, c, t, g, unknown or other
  modified_base (351)..(351): a, c, t, g, unknown or other
  modified_base (354)..(354): a, c, t, g, unknown or other
  modified_base (360)..(361): a, c, t, g, unknown or other
  modified_base (363)..(363): a, c, t, g, unknown or other
  modified_base (367)..(367): a, c, t, g, unknown or other
  modified_base (369)..(369): a, c, t, g, unknown or other
  modified_base (380)..(381): a, c, t, g, unknown or other
  modified_base (383)..(383): a, c, t, g, unknown or other
  modified_base (386)..(386): a, c, t, g, unknown or other
  modified_base (393)..(393): a, c, t, g, unknown or other
  modified_base (397)..(397): a, c, t, g, unknown or other
  modified_base (420)..(420): a, c, t, g, unknown or other
  modified_base (471)..(471): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcgttggtccgagggccgggggggtccctggagactctcctgtgcagtctctggattccaccttagagttatggatgacctggtccncaggctcgaggggagggctggagtggngcanataaanaagacgatnaanaaaccnngngctngngacgcatcacnncncanagacacncaanatcatgtattgacaatagaaacncgacctagagaggacggagacgacggccgtagtattagttggtgcgcgagngtacgaagtacgtagactagttaccgaaggtacgcgtaggtggtatgtacgtttgg

SEQ ID NO: 372177 - DNA, 572 bp, Homo sapiens
  misc_feature: GZ8MTXP02JHJDG.15.67.G01.1.454.CMB.2.raw
  modified_base (342)..(342): a, c, t, g, unknown or other
  modified_base (498)..(498): a, c, t, g, unknown or other
  modified_base (531)..(531): a, c, t, g, unknown or other
  modified_base (548)..(548): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtcctgagactctcctgtgcagtctctggattcacccttagaagttatggatgacctgggtccgccaggctccgaggggaaggggctggaggtgggtggccaaanataaaacaaagaacggaaagtacaaagaaaaaacctataggtaggaacttcgtaggttacgacgggcccgaattccaaccctatcctaccagaacgaacaaacgacccaaagaacttacactagtatttgacaaatagaaacagcctagagacggngaagacgacggcgtagtattatagtgcgtgagntgatagtacgactacanaagtagacgaggtagtatgattcg

SEQ ID NO: 372178 - DNA, 574 bp, Homo sapiens
  misc_feature: GZ8MTXP02HVRXF.15.67.G01.1.454.CMB.2.raw
  modified_base (345)..(345): a, c, t, g, unknown or other
  modified_base (382)..(382): a, c, t, g, unknown or other
  modified_base (395)..(395): a, c, t, g, unknown or other
  modified_base (412)..(412): a, c, t, g, unknown or other
  modified_base (417)..(417): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagttatggatgacctgggtcccgccaggctccgaggggaagggctggaggtgggtgccaaanaataaaacgaaagaacggaaagtcaaagaaaaacctntagtggactctgngacggcattcaccatcncaganaacaacgacaaagaattcactgttatttagacaaatacgaaacagacctagagaggcggaaggacgacggccgttagtattagttgtcgcgacgagagtagagttaaggtacggtcctataaccgtaagtacgacgtagggtagtagtagtagtttg

SEQ ID NO: 372179 - DNA, 690 bp, Homo sapiens
  misc_feature: GZ8MTXP02FHRKM.15.67.G01.1.454.CMB.2.raw
  modified_base (277)..(277): a, c, t, g, unknown or other
  modified_base (323)..(323): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcgtggtttccttgttagttatttagaaggtgtccagtgtgaggtgcacgttggtggagtcggtgggggaggtcgttggtccgacgggtcccgggggggtccctggagacctctccgtgtgcagtctcnggtacttccacccttaagaagttattggatgacctcggggtacccncgaggccgtaccgagggggaacgggtcgtggagggtgggtcggacccaaacgaagtaaaacgaaaggaaccggaagtacgaaagtaaaaaccctgtgtaggtaccttgtaggtacgaccggcccgtacttaccaaccctactcctaccaaacggaacgaaaccgaaacccggaacccgaaaagtaaacttacctaactagtttagtttacgacctaaaagtacgaaacacgcctaggaaacggaggacgggaaacggccgtaaaccggggttccttaggtttaattagtgtcgaacggagaagtatagagttaacgaacgtactacttacgaagtacggtacgtagggttagtagttagaccgtttg

SEQ ID NO: 372180 - DNA, 654 bp, Homo sapiens
  misc_feature: GZ8MTXP02IY4ST.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcttggtccgaggccggggggtcctgagactctcctgtgcagtctctggattcaccttagaagttatggatgaccgtggtccgcaggctccgaggggagggcgtgggaggtgggtggaccaaacaataaaacgaaagaacgggtaagtaacaaagaaaaaacctgtagtaggaccttcgttaggtaacgggaccgggaccgtattacccaacccatcctaccgaagacgaaaccgaaaccgaccgaaaagaacgttcctaacgtagttaacttttcggaactaaaatagaaacgtagacccgtaggaagggacggacgggaacgggacgaaccgggtaccgttagtaatttagtggtggcgtacggtaggagtacgaagttaaggtacgtaacctactacgaaggtacgacgtagggtggtacttaggtactttgg

SEQ ID NO: 372181 - DNA, 541 bp, Homo sapiens
  misc_feature: GZ8MTXP02FN63C.15.67.G01.1.454.CMB.2.raw
  modified_base (426)..(426): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctggtccgcaggctccgagggagggctggagtgggtggaccaacataaaacaaagacggaatacaagaaaaacctatgtgactctgtgacggccgattcacatctcagagacaacgccaaagaattcactntatttagacaaaatgaaacagcctagaggaggcggaaggacacggccgttagtattagtgtgcgcgagattgatagtacgactactanaagtacgacagggtagtatgatttacg

SEQ ID NO: 372182 - DNA, 605 bp, Homo sapiens
  misc_feature: GZ8MTXP02GHDD8.15.67.G01.1.454.CMB.2.raw
  modified_base (423)..(423): a, c, t, g, unknown or other
  modified_base (486)..(486): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcgttgggttttccttgttgtttattttagaaggtgtccagtgtgaggtgcacgtttggtggagttcggtgggggaggtcgtttggtccgacgggcccggggggtccctggacgacttcctccgtgtgcagtctcgtggtacttcctacccgttagtaagttagttggatcgaccgtcgggtcccgccgacggccgtaccggaaggggaaggggtcgtaggggacggcggggtcggtacggaacgaaggaacgaaacgaagtagagagaaacgtnagtgactgagagacgcgactacacacacacagacgacgacgacgaactatatatagtatatanatagacacgacgagagagacggacgacgacgacgtagtagttagtgtcgacgacgagtagtagtagtacgtacgtacgtacgtacgtaagtacgtacgtacggtagtagtagtagtacg

SEQ ID NO: 372183 - DNA, 740 bp, Homo sapiens
  misc_feature: GZ8MTXP02F4YQX.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggccggggggtccctgagactctcctgtgcagtctctggattcaccttagagttattggatgacctggtcccgcaggctccgaggggaacgggctagggagtgggtggaccaaacaataaaacgaaagaaccgggaatacgaaagtaaaaactgtaggtaggaccttcgtagttacgggaccggccgtaaactttaccaaccctattcctaaccccgaaggaaacggaacccaaaacccggaccctaaaacggtaaactttcccgtaaaacctttggtttaacgtttaacgaaaccgtaaaaattacgggaaaacaccggtacccgttaagggaacgggacgggaccgggtaaacgggaacccgggtacccgggtaccggtttacggtttaaagtttacgtttagggtcggaccgggttaacgaaggtaagtacggttaaagttaaggtaacgtacttacgttaaacgaagttacggacgttaggggttacgttaggtacgtagttttgg

SEQ ID NO: 372184 - DNA, 555 bp, Homo sapiens
  misc_feature: GZ8MTXP02HQCLA.15.67.G01.1.454.CMB.2.raw
  modified_base (382)..(382): a, c, t, g, unknown or other
  modified_base (411)..(411): a, c, t, g, unknown or other
  modified_base (452)..(452): a, c, t, g, unknown or other
  modified_base (454)..(454): a, c, t, g, unknown or other
  modified_base (493)..(493): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtctgggggaggcttgggtccaggccgggggggtccctgagactctcctgtgcagtctctggattcacccttagagttatggatgacctggtccgccaggctccgaggggaagggcgtggaggtgggtggaccaaacaataaaacaaagaacgaagtacaaagaaaacctatgngtactcgtagtgacggcgatcacccatcncagagacaacgacaaagattcatgtatttgacaaatagaananactgagagaggaggacgacgaccgtgtattagttgtggngacgagtagtagtagtagtacgtactacgtacgaagtacgtacgtaggtagtagtagtagtg

SEQ ID NO: 372185 - DNA, 778 bp, Homo sapiens
  misc_feature: GZ8MTXP02IWD2X.15.67.G01.1.454.CMB.2.raw
  modified_base (263)..(263): a, c, t, g, unknown or other
  modified_base (310)..(310): a, c, t, g, unknown or other
  modified_base (762)..(762): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgagtgcacgttggtggagtcgtgggggaggcttggtccgaggcccgggggggtcctggagactctcctgtgcngtctctggtattccaccttagaagttagtggatcgaccgtgggtccnccgaggctccgagggggaacgggtcgtaggggacggtggggtacggaccccaaaagtaaacgtaaaaaacgaaaaacggggaaaccgggtaaaaggtaacgtaaaaaacggtaaaaaaaacccgttagttagggttaacggtaaccgttaccgttaagggtaacgggtaaacccgggggtcccggttaaaactttcccccggaaacccctacgttacccgttaccgaaacggaaacgtaaccaaaacgttacgaaaccctaaaaggtaaaactttactaaccgtttaggtttaagtttacgtaaacgtaaaattaacgaaaaccgtaacgacccgttaggaagggtacggggaacgaaacgggtaaccgacgggtaccggttagttaagtttagtcggtacggagacggtaagtacgtagtaagtagtacgacttactaacgtaacgtacgngaggtagtataggtag

SEQ ID NO: 372186 - DNA, 547 bp, Homo sapiens
  misc_feature: GZ8MTXP02JSKEX.15.67.G01.1.454.CMB.2.raw
  modified_base (410)..(410): a, c, t, g, unknown or other
  modified_base (453)..(453): a, c, t, g, unknown or other
  modified_base (524)..(524): a, c, t, g, unknown or other
  modified_base (536)..(536): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccggggggggtccctgagactctcctgtgcagtctctggattcacccttagaagttattggatgacctggtccgccaggctccgaggggagggctggagtgggtggccaacataaacaaagacggaagtcaagaaaaacctatgtggactctgtgacggccgattcaccatctccaganacaaacgccaaagaattcactgtatttagactaaatcgaaacngacctgaagaggcggagacgacggccgtgtattattgtgcgacgagagtcgaattagtacgactcctaagngtaggctagggngtatggattgg

SEQ ID NO: 372187 - DNA, 560 bp, Homo sapiens
  misc_feature: GZ8MTXP02FOYB2.15.67.G01.1.454.CMB.2.raw
  modified_base (346)..(346): a, c, t, g, unknown or other
  modified_base (380)..(380): a, c, t, g, unknown or other
  modified_base (407)..(407): a, c, t, g, unknown or other
  modified_base (410)..(410): a, c, t, g, unknown or other
  modified_base (413)..(413): a, c, t, g, unknown or other
  modified_base (432)..(432): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcagttggtggagtcgtgggggaggtcttggtccgaggcccggggggtccctgagactctcctgtgcagtctctggattcacccttagaagttattggatgaccgtgggtccgccaggctccgaggggagggctggagtggggtgccaanataaaacgaaagacggaagtacaagaaaaacctntagtgactctgtagacggcattcaccntcncanacacacgcaaagatcactnttatttgacaaaatgaaacagcctgaacggagacggaggaccgacggccgtagttaatgttaggtcgcggacgagatacgtaataggtaacactactaacgaagtagcgagggtgtaatcgtagtttg

SEQ ID NO: 372188 - DNA, 561 bp, Homo sapiens
  misc_feature: GZ8MTXP02HRM4O.15.67.G01.1.454.CMB.2.raw
  modified_base (341)..(341): a, c, t, g, unknown or other
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggagcttggtccaggccgggggggtccctggagactctcctgtgcagtctctggattcacccttagaagttatggatgacctgggtccgcaggctccgaggggaaggggctgggagtgggtgccaanataaaacaaagacggaagtacaagaaaaacctatagtggactcgtgtagaccggcgattcacctatcaccagacgaacaaacgaccaaagaacttacacttgttaatttcgactaaatgaaacagacctagagaggacgaaggacgacggcgtgtattattgtgacgcgagatagatacgtagactactaanaagtagacgtagggtagtatcgtattgg

SEQ ID NO: 372189 - DNA, 665 bp, Homo sapiens
  misc_feature: GZ8MTXP02GG1RU.15.67.G01.1.454.CMB.2.raw
  modified_base (265)..(265): a, c, t, g, unknown or other
  modified_base (309)..(309): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggaggtcgtgggggaggcttgggtccgagggcccggggggtccctggagactctcctgtgcngtctctggattcacccttagaagttattggatgacctgggtccnccgagctccgaggggaacgggcgtgggaggtggggtcggaccaaacgaagtaaaacgaaaaggaaccggaaagtacaaagaaaaacctgtagtagactcgtagtcggacggccgtaattccgaccactcctaccgaagaaacgaccaaaaccgacctaaaagaaacttacccaacgttagttaaagttttacgaactaaaacgtagaaaaccgtacgacccgtaggaaggacgggaccggaagggaacccgaacgggtccgttagttaattagtttcggtagccgacggtagtagttggaaagttaggtacgtaacttcgtaacgaagtacgacgtagggtagtagtacgtagttg

SEQ ID NO: 372190 - DNA, 555 bp, Homo sapiens
  misc_feature: GZ8MTXP02FTWRR.15.67.G01.1.454.CMB.2.raw
  modified_base (378)..(378): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctggggtccgccaggctccgaggggaaggggctgggagtggggtggccaaacataaaacaaagacggaagtcaagaaaaacctntgtggactctgtgacggcattcaccgatctccagagacaacgccaagaacttcactgttatttgactaaatagaaacagcctagagaggaccggaggtacgacgggccgtgtacttatgtgcgcgtagatgagtacgtacgactcgtacaagttagactagggtgtatagagtttcg

SEQ ID NO: 372191 - DNA, 564 bp, Homo sapiens
  misc_feature: GZ8MTXP02GB6FA.15.67.G01.1.454.CMB.2.raw
  modified_base (418)..(418): a, c, t, g, unknown or other
  modified_base (529)..(529): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgaccgtgggtcccgccaggctccgaggggaaggggctgggaggtggggtggaccaaacaataaaacgaaaggaacggaagtcaaagaaaaacctatgtggactctgtgacggcgattcaccatcnccagagacaacgccaaagaacttcactgtatttgacaaatgaaacagcctaggagagggcgaaggccgaacggccgtgtaatttagtgtgcgagagatcgatagtagactntaacgaaggttagactagggtaggtatacgatttg

SEQ ID NO: 372192 - DNA, 534 bp, Homo sapiens
  misc_feature: GZ8MTXP02FKJIU.15.67.G01.1.454.CMB.2.raw
  modified_base (343)..(343): a, c, t, g, unknown or other
  modified_base (528)..(528): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaagggctggagtgggtggccaaanataaaacaaagacggaaagtcaagaaaaacctatgtggactctgtgacggccgattcaccatctccagagacaacgccaaagaattcactgtatttgcaaaatgaaacagacctgagaggacgagacacggcgtgtattatgtgcgcgagatgatagtacgactctacaagtacgcgaggtgtancgattg

SEQ ID NO: 372193 - DNA, 692 bp, Homo sapiens
  misc_feature: GZ8MTXP02FJKSS.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttatttagaaggtgtccagtgtgaggtgcacgttggtggagtcggtgggggaggtcgttgggtccgacggggtcccgggggggtccctggacgacttccttccgtgtcgctacgtcttcgtggtacttcctaaccccgttaaggtaagttattagggatcggaccgttgggtccccgccaggcctcgaagggggaagggcgtgggaggtggggtcggaccaaaacaaagtaaaaacgaaaaggacggaaagtacgaaagtaaaaaacctagtggagaccttgtaggtaacgaccgggcctaagttaccaacctactccgtacccaaggaacaaccaaaccgaccaaaagtaacttcaactgttaatttgaactaaaatcgaaaacacgaccgtaggaaggacggacggaacggaaccgtacgggtccgttagttaactttgtacggtacgcgacggtaagagtagtaaagtagtacgaacttacgaagtaacggtagacgtaggggtgtaagtcggtagtttacgg

SEQ ID NO: 372194 - DNA, 535 bp, Homo sapiens
  misc_feature: GZ8MTXP02FFPYA.15.67.G01.1.454.CMB.2.raw
  modified_base (453)..(453): a, c, t, g, unknown or other
  modified_base (519)..(519): a, c, t, g, unknown or other
  modified_base (531)..(531): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcaccccttagaagttattgggatgacctgggtccgccaggctccaggggaaggggctggagtgggtggccaacataaacaaaagacggaaagtcaagaaaaaaccctatagtggactctgtgacggccgattcaccatctccagagacaaacgcccaaagaattcactgtatttgcaaaatnaaacagcctgagaggcgagacacggcgtgtatatgtgcgcgagatgatagtagactctacaagtancgaggtggttangatg

SEQ ID NO: 372195 - DNA, 547 bp, Homo sapiens
  misc_feature: GZ8MTXP02JXCAS.15.67.G01.1.454.CMB.2.raw
  modified_base (502)..(502): a, c, t, g, unknown or other
  modified_base (522)..(522): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccaggggaaggggctggagtgggtggccaaacataaaacaaaagacggaaagtacaagaaaaaacctatagtggaactctgtagacgggccgaattcaaccatctccagagacaaacgccaaagaatcactgtatttgacaaatgaaacagcctagagagcgagacacggccgtgtatattgtgcgcganatgatacgtagactctaaanaagtagacgaggtagtagtagagtg

SEQ ID NO: 372196 - DNA, 665 bp, Homo sapiens
  misc_feature: GZ8MTXP02HETB5.15.67.G01.1.454.CMB.2.raw
  modified_base (304)..(304): a, c, t, g, unknown or other
  modified_base (344)..(344): a, c, t, g, unknown or other
  modified_base (637)..(637): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattccacccttagaagttatggatgacctggccncaggctccgaggggaagggctggaggtgggtggaccaaanaataaaacaaaagaacgggaaagtacaaaagaaaaaaacctagtagtaggaacttcgtaggtagggaaaccggtccgtaaactttaccaaaccccctaaattccctacccaaaaggaaaccgaaacccgaaaacccggtacccaaaacggtaaaatttaacccaactttacggttaaacttttaggacctaaaaagtacgaaaaccaaaggcctaggaaagacgggaccgggaaggaacccgtacggacccggttagtaattagttgtgacgcgaggatgataacgtagactnacaagtagacgaggtagtagtgagttcg

SEQ ID NO: 372197 - DNA, 564 bp, Homo sapiens
  misc_feature: GZ8MTXP02GD6FC.15.67.G01.1.454.CMB.2.raw
  modified_base (261)..(261): a, c, t, g, unknown or other
  modified_base (305)..(305): a, c, t, g, unknown or other
  modified_base (373)..(373): a, c, t, g, unknown or other
  modified_base (382)..(382): a, c, t, g, unknown or other
  modified_base (403)..(403): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcngtctctggattcacccttagaagttattggatgacctgggtccnccgaggctccgaggggagggctggagtgggtggccaacataaaacaaagacggaagtcaagaaaactntagtgactntgtgacgcgatcacatctcanagacaacgaccaagatacactgtatttgactaaatgaaacagacctaggagaacgggcggaaggaaccacgttacggccggttagttatttaacgttgtagtcggcgagtagtagaactagtacgactacgtaactaggtacgcgaggtggtaactgtaag

SEQ ID NO: 372198 - DNA, 573 bp, Homo sapiens
  misc_feature: GZ8MTXP02I108I.15.67.G01.1.454.CMB.2.raw
  modified_base (355)..(355): a, c, t, g, unknown or other
  modified_base (390)..(390): a, c, t, g, unknown or other
  modified_base (394)..(394): a, c, t, g, unknown or other
  modified_base (421)..(421): a, c, t, g, unknown or other
  modified_base (552)..(552): a, c, t, g, unknown or other
tcagtctacgtagccacgaccggtgctcgatttagagtatacatattgggtttgaggtctcagagaggagccttagccctggactccaaggcctttccatttggtgatcagcactgagcacagaggactcaccatggagttggggttgagctgggttttccttgttgttattttagaaggtgtccagtgtgaggtgcacttggtggagtcgtggggggagcgtttggtccaggccgggggggtccctggagactctcctgtgcagtctctggattccacccttagagttagttggatcgaccgtgggtccccgccgaggcctccgaggggaagggcgtggagtgggtgaccaaanaataaacgaaagacggaaagtacaaagtaaaactntagnggtactcgtgtagaccggcgatcaccngtcctccgagacgacaacgaccaagaactcacttgtaacttgaacaaagtagaacagcctagagaggacgaggactccggcgttagtattagtgtgcgtgagatgaagtacgtagactctagaacgtaagngaggtgtatcgagttgtttag

SEQ ID NO: 372199 - DNA, 790 bp, Homo sapiens
  misc_feature: GZ8MTXP02HRPCF.15.67.G01.1.454.CMB.2.raw
  modified_base (356)..(356): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgagggcccgggggggtcctggagactctcctgtgcagtctctggattcacccttagaagttatggatgaccgtgggtcccgccaggcctccgaaggggaggggcgtgggaggtgggtcggaccaaanaaacgtaaaacgaaaaggaaccggtaaagtacgaaaagtaaaaaaacccctgtaggtacggtacttcgtaggttacggaaccggggtcccgtaactttacccaaacccctaattccctaccgaaacggaacgaaaccaaaacccggacccaaaaggtaaactttaccctaaaccgtttaggtttaattttacggaaacctaaaagttacgaaaaccgacggtacccttaaggggaagggaacgggaccgggaaaggggtaacccggaaaccgggggtcccggtttaagggtttaatttaacggtttacggttggacccgggacggtaaaggtaagttaggtaaacgtttacggtaaaccggtacctttaccgtaaacgtaaggtttaaccggaacggtagggggttaaggtttaagttcggtaatttttacggg

SEQ ID NO: 372200 - DNA, 565 bp, Homo sapiens
  misc_feature: GZ8MTXP02JCPTU.15.67.G01.1.454.CMB.2.raw
  modified_base (308)..(308): a, c, t, g, unknown or other
  modified_base (325)..(325): a, c, t, g, unknown or other
  modified_base (372)..(372): a, c, t, g, unknown or other
  modified_base (509)..(509): a, c, t, g, unknown or other
  modified_base (525)..(525): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgagggcccgggggggtccctggagactctcctgtgcagtctctggattccacccttagagttatggatgacctggtccncagctcaggggagggcnggagtggtggaccaacataaaacaaagacgaatacaagaaaaacctntagagactctgtacgacgggcctattccaccatctccagaagaccaaacgaccaaagaattcaacttgtatttagacaaatagaaacagcctagagaggcggaagacgacggcgtagttattagttgtgcgaggtanatacgtaatacggtanaactctaactaagtagacgtagggtaggtactagtagttg

SEQ ID NO: 372201 - DNA, 592 bp, Homo sapiens
  misc_feature: GZ8MTXP02IYKWU.15.67.G01.1.454.CMB.2.raw
  modified_base (394)..(394): a, c, t, g, unknown or other
  modified_base (542)..(542): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccagggccggggggtcctgagactctctgtgcagtctcgtggtattcacccttagaagttattggatcgaccgtggtcccgccaggctccgaggggaagggctggaggtgggtggaccaaacataaaacaaaagacggaagtacaaagaaaaacctatagtaggacctntggtagacgggcctagttaccaccactcctaccaagacgaaccaaacgaccctaaagaacttacgacttagtagtttagaactaaatagaaacagtccagagacggcgaacggaccgacggtcgtagtattagttgtcgacgcgaagngtagaagtagtacacgtacacgaagtacgagtaggtgtatcggtatttgg

SEQ ID NO: 372202 - DNA, 617 bp, Homo sapiens
  misc_feature: GZ8MTXP02F9VW0.15.67.G01.1.454.CMB.2.raw
  modified_base (438)..(438): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctgggtccgccaggcctccgaggggaaggggctgggaggtgggtggaccaacaataaaacgaaagacggaagtcaagaaaaacctatgtggactctgtgacggccgatcaccatctacagagacaacgaccaaagattcactntatttgactaaatgaaacgagccgtaggaaggagggaccggaaggaaccgaccgggtaccgttaggttaacgtttaagttggtacgcggaccggaagtaatggtaaataacggttaacgaccgttacctaaccgaaggttaaggaccgtaaggggtaggttaacgtggtaactttaggg

SEQ ID NO: 372203 - DNA, 633 bp, Homo sapiens
  misc_feature: GZ8MTXP02HXRTX.15.67.G01.1.454.CMB.2.raw
  modified_base (305)..(305): a, c, t, g, unknown or other
  modified_base (308)..(308): a, c, t, g, unknown or other
  modified_base (346)..(346): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgaggcccgggggggtccctgagactctcctgtgcagtctctggattcaccttagaagttatggatgacctggtccnccnggctccgaggggagggcgtggaggtgggtggaccaaanataaaacgaaaggacggaagtacaaagaaaaacctagtgtaggactcgtggtacgaaccggggtccaacttcccacctattccctacccaagacgaaaccgaaaccgacccaaaagtaacttctaacttgttactttagaacctaaaatgaaacagtacctaggaggagggacggaggaccgacggccgttagtattagttgtgcgtacggagtagtagaagtaaagttacgaacttaccgtaacgtaaggtacgacggtaggggttaggtagttaggtaagtttgg

SEQ ID NO: 372204 - DNA, 835 bp, Homo sapiens
  misc_feature: GZ8MTXP02H06RX.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttgggtccgaggcccggggggtccctggagactctcctgtgcagtcttcgtggtacttaccctaccgttaaggtaagtttagttaggtataccgtaccggtccgggtccccgaccggacggtccgtaccggaagggggaacgggtcgtggggtagggtcggggtccggaacccgaaaacgtaaaacgtaaaaaaccggaaaacgggaacgggtaaaacggtaaccgaaaaaacggtaaaaaaaccccgttgttacgggtaacgggtaacctttcggtacggttacgggaaacccggggttcccgttaactttaacccccgacccttaactccccgtaaccgaaacggtaaacgaaacccaaacccggaaacccctaaaaggttaaccttaccgtaaacgttttaggtttaacttacggaaaacttaaacgttacgaaaccgtacggtaccgtaggggaaacgacggggaacggaccggaaccgtacccggggtacgttagttaaacgtttggttgccggtaccgaggtaagtagttacggtagtttaaagttaccgaaccttacgtacgaacggttacggagttacggggtagttagtagtttaaccgtttgg

SEQ ID NO: 372205 - DNA, 789 bp, Homo sapiens
  misc_feature: GZ8MTXP02HTN20.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaggtgtccagtgtgaggtgctacgttggtggagtcggtgggggaggtcgttggtccgacgggcccggggggtccctggacgtactctcctgtgcagtctctggtacttcctaccttagtaagttattggatcgtaccgtgggtcccgcgacggccgtaccggaggggaacggggcgtggggaggtggggtcggaacccaaaagtaaacgtaaaaacgaaaagggaaaccggtaaaggtaaaccaaaaggtaaaaaaccctagttacggtacggtaaccttcgttacgggtaagacccggggtaccgtaaagttacccaaccttaacctacccgtaaccgaaacggaaaccgaaacccgaaacccggtaaaaccctaaaaggttaaaacctttacccgttacgttaacgtttaacgttttacgaaaccttaaaaggtaaccgtaaaacgacgtaccgtagggaacgggacgggaacggaacgggacccaacggggttccgttaaggttactttaaggttggtacgcgtacggtaagtagtacgtaagttaaacgggtactaaccgtagtaacgtaaggtacggtagtacgggtaggttactaggtttacgtttag

SEQ ID NO: 372206 - DNA, 590 bp, Homo sapiens
  misc_feature: GZ8MTXP02JVTJ4.15.67.G01.1.454.CMB.2.raw
  modified_base (344)..(344): a, c, t, g, unknown or other
  modified_base (374)..(374): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcttggtccaggccgggggggtccctgagactctcctgtgcagtctctggattcacccttagaagttattggatgaccgtgggtccgccaggctccgaggggaaggggctggaggtggtggccaanataaacaaagacgaagtcaagaaaaacctntgtggactctgtgacggccgattccaccatcctaccagacgaacaacgacccaaagaacttcacctggttattttacgacaaagtacgaaactagaccgtaggaagagggaccgggaagggaccgaaccgggccgttagtattagttggtagccgtacgagataggatacgtacgtactactacgaagtacgagagggtaggtactaggacttagg

SEQ ID NO: 372207 - DNA, 737 bp, Homo sapiens
  misc_feature: GZ8MTXP02JRKWN.15.67.G01.1.454.CMB.2.raw
  modified_base (345)..(345): a, c, t, g, unknown or other
tcagtctacgtagccacgaccggtgctcgatttagagtatacatattgggtttgaggtctcagagaggagccttagccctggactccaaggcctttccacttggtgatcagcactgaacacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttattggatgacctgggtccgccaggctccgagggaaggggctggagtgggtggaccaanataaacgaaaagacggaaagtaccaagaaaaactatagtaggactcgtgtagaaacgggccgaattcaacctatcctacccaagacgaaaccaaacgacccgaaaagtaacttacaaaccgttagttaaacgttttcggaaacctaaaaagttacggaaaacccttaaagacccccgttaaggaaagggtaacggggaccggaaggggaaaccgaaccggggtacccggtagggtttaatttacggtttaaggcggtaccggaccggaaaggtaagtttaggaaacgttaaaggttaaacggtaaccttaacccgttaaacgtaaacggttaaggaccggtaaaacggggttacgggggttaaaacttcggaaagtttccgtttttaaacgg

SEQ ID NO: 372208 - DNA, 585 bp, Homo sapiens
  misc_feature: GZ8MTXP02GZ6JE.15.67.G01.1.454.CMB.2.raw
  modified_base (349)..(349): a, c, t, g, unknown or other
  modified_base (528)..(528): a, c, t, g, unknown or other
  modified_base (534)..(534): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggattcacccttagaagttattggatgacctgggtccgccaggctccgaggggaaggggctgggaggtggggtggaccaaanaataaaacaaaagaccgggaaagtcaaagaaaaacctagtgtaggactcgtgtagacgggccattccaccatctaccagacgacaaacgaccaaagacttacactgtatttagactaaaagtgaaaccagacctaggagagggcgagaacgacggccgttagtaattattggtgaccgngtaagngtaggaactagtacgactactaagaagtagcgtaggtggataggtagtttg

SEQ ID NO: 372209 - DNA, 553 bp, Homo sapiens
  misc_feature: GZ8MTXP02FPHII.15.67.G01.1.454.CMB.2.raw
  modified_base (304)..(304): a, c, t, g, unknown or other
  modified_base (498)..(498): a, c, t, g, unknown or other
  modified_base (546)..(546): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctgggtccncaggctccgaggggaaggggctggagtggggtggccaaacgataaaacaaagacggaagtacaagaaaaacctatgtaggattcgtgtagacggccgaattccaaccatctccgagagacaacgacaagaattcactgtatttgacaaatgaaacagcctgagaggacgaggaccacggcgtagttatagttgngcgacgagatacgatagtacgactcagaagtacgacgtaggtagtagngtagtcg

SEQ ID NO: 372210 - DNA, 561 bp, Homo sapiens
  misc_feature: GZ8MTXP02IU6WL.15.67.G01.1.454.CMB.2.raw
  modified_base (378)..(378): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctgagactctcctgtgcagtctctggattccacccttagaagttattggatgacctgggtccgccaggctccgaggggaaggggctggaggtgggtggccaacataaacaaagacggaagtacaagaaaacctntagtggactctgtagacggcctattccaccatctaccagacgacaacgacaaagattcactgtattgacaaatgaaacagcctaggagacggacgacggacgacggcgtagtattagtgtgacgacgagagtagaattaggacgtactctaacgaagtagacgtagggtgtagtgtagtttcg

SEQ ID NO: 372211 - DNA, 733 bp, Homo sapiens
  misc_feature: GZ8MTXP02JHXMS.15.67.G01.1.454.CMB.2.raw
  modified_base (720)..(720): a, c, t, g, unknown or other
tcagtctacgtagccacgaccggtgctcgatttagagtatacatattgggtttgaggtctcagagaggagccttagccctggactccaaggcctttcccacttggtgatcagcactgagcacagaggactcaccatggagttgggctgagctgggttttccttgttgtttattttagaaggtgtccagtgtgaggtgcacttggtggaggttcgtggggggaggtcgttggtccgagggcccgggggggttccctggagacctctcctggtgcagtctcgtggacttcacccttagaagttattggatgaccgtgggtcccgcgaggctccgaggggagggcgtggaggtgggtggaccaaacacgtaaaacaaaggtacgggaaagtaccaaagaaaaaccttagtaggtaggtaacttcgtaggtacggacggggcccgtaactttccgacccgtatccgtacccaaaggaacgaacccgaaacgacccgaaacgtaaactttaccgaccgtttagttaacgtttttcgaacctaaaagtcgaaaaccgacgtcccgtagggaggaacgggaccggaaggacccggacgggtacccggttaggtttacgttaagtttggtacgacgtacggtaagtagttaacggaagttaaacggttacggtaaaaccttaccgtaaaccgtaacggtacgaacggttaacggggtggtttaaaacnggttattttacgg

SEQ ID NO: 372212 - DNA, 587 bp, Homo sapiens
  misc_feature: GZ8MTXP02IU4D5.15.67.G01.1.454.CMB.2.raw
  modified_base (312)..(312): a, c, t, g, unknown or other
  modified_base (424)..(424): a, c, t, g, unknown or other
  modified_base (530)..(530): a, c, t, g, unknown or other
  modified_base (560)..(560): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggcttgggtccaggcccgggggggtccctggagacctctcctgtgcagtctctggattcacccttagaagttattgatgaccgtcgggtccnccgaggcctccgaggggaagggctggaggtgggtcggccaaaacaataaaacaaaggacggaagtacaaagaaaacctagtgtgactcgtgtacgacgggcgattccaaccntctaccagacgaacaaaccgccaaagtaacttcacttagtatttgacaaatgaaacagcctaggagacgggacggaggaccgacggcgttacgttaattacgttgngtcgacgagatagaatacgtacgactctanaagtacgagtaaggtggtatgagtttg

SEQ ID NO: 372213 - DNA, 680 bp, Homo sapiens
  misc_feature: GZ8MTXP02IPSZX.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggcccggggggtccctgagactctcctgtgcagtctcgtggtacttcctacccttagaagtttatggatcgaccgtgggtcccgcgacggctccgaggggaagggcgtgggagtggggtcggaccaaagaacgtaaaacgaaaggaaccggaagtaccgaaaagtaaaaaaccccgtagtacggtacggacttaccgtaggttagaccgggggtcctaattacccgaacctactaccctacccagaaccgaacaaaccgtaccaaagacttacacgttagttatttagaaacctaaagtacgaaacgtacgaccgttagaacgggaagggacgggaaacggacgaacccgggtaccggttagttaagttaccggtttgagcggtacgaaggtatacgtaaataggtacgtactacctagaagttagacggtagggtgtaactggtatttcgg

SEQ ID NO: 372214 - DNA, 668 bp, Homo sapiens
  misc_feature: GZ8MTXP02JKO39.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtcctgagactctcctgtgcagtctctggattcacctagagttatggatgacctgggtccgccaggctccgagggggaagggctggggagtggggtcgaccaaacgaataaaaccgaaaggaaccggaaagtacgaaaggaaaaaacccttgtaggtcgaacttcgaggtacggacggggtaccctattacccgaacccattacctaccgaagacggaaacaaacccgacccgaaagtaattaccgaacgttgttaagtttacgaactaaaagtcgaaaacagccctaggaaggaacgggacgggaacggaccgacgggaccgttagttaacgttagttcgacgccgtacgaaggtatagaagttaacggtacgaacgttccgtaacgtaaggtaacgacggtaaggtaggttaactggtacgtttaacgg

SEQ ID NO: 372215 - DNA, 592 bp, Homo sapiens
  misc_feature: GZ8MTXP02GZRTZ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcggtgggggaggtcgttggtccgaggcccgggggggtccctgagactctctgtgcagtctctggattcacccttagaagttattggatgaccgtgggtccgcaggctccgaggggaaggggctgggagtggtgaccaaacataaaacaaagacggaagtacaagaaaaacctgtgtaggactctagtgacggccgattccacatcaccagacgacaaaccgaccaaagaattccactgttatttacgacaaaattagaaacagaccttagaaggtacgggacggaacgggaaaccaccggggaccgttagtaatttagttgtcgcgcgagaagtgaatagtacgactcgtaacaagttagcggtaggtagttatgtagtttg

SEQ ID NO: 372216 - DNA, 557 bp, Homo sapiens
  misc_feature: GZ8MTXP02H4IZS.15.67.G01.1.454.CMB.2.raw
  modified_base (468)..(468): a, c, t, g, unknown or other
  modified_base (501)..(501): a, c, t, g, unknown or other
  modified_base (514)..(514): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtgggggaggcttggtccaggccgggggggtccctgagactctcctgtgcagtctctggattcacccttagagttatggatgaccgtgggtccgccaggctccgaggggaggggctgggaggtggggtcggccaaacaataaaacgaaagaacgggaagtacaagaaaaacctatgtaggactctggttagacgggccgtattcacctatctccagagacaacgaccaaagacttcactgtatttgacaaatgaaangcctagagagggcgagacgacggcgtagtattntgtgcgtcgagangatagtagactacactaaggtagacgagggtgtacgtgatttg

SEQ ID NO: 372217 - DNA, 644 bp, Homo sapiens
  misc_feature: GZ8MTXP02JEIK6.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccggggggggtccctggagactctcctgtgcagtctctggattcacccttagagttattggatgacctgggtccgccaggctccgaggggaagggctggaggtggggtggcccaaacaataaaacaaaggacggaatacaagaaaaacctatgtggactctgtgaccgggccattcaccatctaccagacacaaacgcccaaagacttacacgtgttatttacgactaaaatcgaaacacggtacctaggaaggaggggacgggaacggaaccgtaaccgggccggtaggttatttagttgggtagccggtacggaagtaaagttggaaacttaacggggttaactaaccgttaacgtaacgtaaggtaacggtacggtacggggttaggttaactcggttaagttcgg

SEQ ID NO: 372218 - DNA, 638 bp, Homo sapiens
  misc_feature: GZ8MTXP02JEBWV.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcgtgggggaggtcttgggtccgagggcccgggggggtccctggagactctcctgtgcagtctctggattcacccttagaagttattggatcgaccgtgggtcccgccgaggcctccgaggggaaggggctgggaggtggggtcggaccaaaacaataaaacgaaaggacggaatacaaagaaaaacctataggtaggactcgtagtacgaccggtccgaattccaaccattccaccgagacgaacaaacgaccaaagtaacttcacttgttaatttagactaaaatagaaacacgtacctaggaaggacgggcggaacggtaaccgaccggggtccgtaggttaaattcgtggtacgcggtacgagagtggaaattaagtacgaacttcgaaacgtaagtaggacgtaggttagggtataggtatttgg

SEQ ID NO: 372219 - DNA, 577 bp, Homo sapiens
  misc_feature: GZ8MTXP02IKWNM.15.67.G01.1.454.CMB.2.raw
  modified_base (258)..(258): a, c, t, g, unknown or other
  modified_base (341)..(341): a, c, t, g, unknown or other
  modified_base (452)..(452): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtcctgagactctcctgtgcngtctctggattcaccttagagttattggatgacctgggtccgcaggctccgaggggaagggctgggaggtgggtcgccaaaanataaaacaaaggacggaagtacaagaaaaacctgtgagactcgtagtgaccggcgtaattccacctatcaccagacacaaacgcaaagatcactgtattgacaaatgaaancgctagaggaggacggacggtaccgacgggtcgttagtaagtttattacggtgccgtacgagagtgtaaatacggtacgtacctattaaacgaaggtacgacgtagggttagtataggtatttgg

SEQ ID NO: 372220 - DNA, 767 bp, Homo sapiens
  misc_feature: GZ8MTXP02GVSBI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggtcgttggtccgagggcccggggggtccctgagactctcctgtgcagtctcgtggattccaccttagaagttatggatcgacgtgggtccgcgagctaccgaggggaaggggctgggagtggggtacggacccaaaagaagtaaaaacgaaaaggaaccggaaagtaacaaaagaaaaaacccttagtaggtacggacttcgtaggtacggaaccgggtcccgtaatttcccaaacctactccgtacccgaagaaacgaacaaaacccggacaaaacggtaattacctaacttaggttaactttaggaaccgtaaaaatacggaaaacacgtaccgttaggaaggaacgggaccggaagggaaacccgaccggggttaccggtttaagttaaagttttaacgttgggtacggacccggtaacggaaggtaagttaccggtaaaagttaaacggggtaagtaaaaccttacccgtaaaagtaaacggttaaacgtacggggtaaacgggtttagggttaaacgtacgggttaacctttttaacgggg

SEQ ID NO: 372221 - DNA, 623 bp, Homo sapiens
  misc_feature: GZ8MTXP02ID272.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttgggtccaggccgggggggtccctgagactctcctgtgcagtctctgtattcaccttagagttatggatgacgtggtccgcaggctccgaggggaagggttggaggtggtgaccaacgaataaacaaagacggaaagtcaaagaaaactatagtagactcgtagtacgaacggccgattcaccctatcctacaagacgaaccaacgaccaaagtacttacacttagtactttgactaaaatgaacacgtccgtaggaacggagggacgacggtaaccgacggtaccgttagttatttaagttcgaggccggagtaacgattaggaatttaaacggacggtactaccgttaacgaaaggttcgagtaaaggggttggttaattccgggtattacggtttag

SEQ ID NO: 372222 - DNA, 680 bp, Homo sapiens
  misc_feature: GZ8MTXP02GWZL7.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccgaggccgggggggtccctgagactctcctgtgcagtctcgtggtattccacccgttagaagttattggatcgacctgggtcccgccgaggcctaccgagggggaaggggctagggaggtgggtcggcccaaagaataaaacgaaaggtacggaatcgaaaagtaaaaccctgtagaggtacttcgtggtacgaccgggtccgaacttccacccaattccaccgagaaacgacaaaccggtaccaaaaggtactttacacgttagttaatttcggaactaaaagtcgaaaactagacccgttggaaacggagggaccggaaggggaacccgacggggttacccgtaaggttttaactttaagtttcgggtacgcggtaacgaggtacttggaaacttagtaaacgtccttcgtaacgaaggttaacggagtagggttagtagtacgtattg

SEQ ID NO: 372223 - DNA, 605 bp, Homo sapiens
  misc_feature: GZ8MTXP02IGC4R.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttgggtccgagggcccgggggggtccctggagactctcctgtgcagtctctggattcaccttagagttattggatgacctggtccgccaggctccgaggggaaggggctggaggtggggtggaccaaacaataaaacaaaggaacggaagtacaaagaaaacctagtgtgactcgtagtgaccggggcctattaccaccatcctccagacgaacacgacaaagtaactcactgttatttgactaaaatcgaaacacgaccgtaggaaggcgggacgggaacggaccgacgggccgttgttaatttgttgtggcgacgaagagtagtaaagtaagtacgaacttcgtaacgaaggttacgacgtagggtggtaacgtgatttgg

SEQ ID NO: 372224 - DNA, 543 bp, Homo sapiens
  misc_feature: GZ8MTXP02IEY8X.15.67.G01.1.454.CMB.2.raw
  modified_base (309)..(309): a, c, t, g, unknown or other
  modified_base (380)..(380): a, c, t, g, unknown or other
  modified_base (393)..(393): a, c, t, g, unknown or other
  modified_base (417)..(417): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggcttgggtccaggcccgggggggtccctggagactctcctgtgcagtctctggattcacccttagagttattggatgacctgggtccnccaggctccgaggggagggcgtggaggtgggtggaccaacataaacaaagacggaatacaagaaaaacctntgtggactcgtgngacggccattccacatctccaganacaacgaccaaagacttcactgtatttgacaaatgaacagctaggagagggcgaaggacacggcgtgtattagtgtgcgcgagatgatatacgactactacgaagtagcagggtgtagtgagttcg

SEQ ID NO: 372225 - DNA, 579 bp, Homo sapiens
  misc_feature: GZ8MTXP02FZ4LH.15.67.G01.1.454.CMB.2.raw
  modified_base (413)..(413): a, c, t, g, unknown or other
  modified_base (416)..(416): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctggtccgcaggctccgaggggaggggctgggagtggggtcggaccaacaataaaacgaaaggaacggaagtacaaagaaaaacctatggtagactcgtagtagacggccattcaccntcncagagacaacgaccaagaattcactgttaattgacaaatgaaacagcctaggaagaggacggaggaaccgacgggtccgtattaagttattggtcgcggacgaggattaggaaataggtactacgtctaacgaaggtagcgtagggtagtagtagatttacgg

SEQ ID NO: 372226 - DNA, 631 bp, Homo sapiens
  misc_feature: GZ8MTXP02JNROZ.15.67.G01.1.454.CMB.2.raw
  modified_base (570)..(570): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggtcttggtccgagggcccgggggggtccctggagactctcctgtgcagtctcgtggattccacccttagaagttatggatcgaccgtggtccgccgaggcctccgaaggggaaggggcgtggggaggtggggtggacccaaaacgaataaaacgaaaaggaacggaaagtacaaagaaaaacctagtagtaggactcgtaggtacgaccgggccgtattaccacctattaccaccaagaacgaacaaaccgaccaaagaactttaccaacttgtaatttgaactaaaagttagaaacagtaccgtaggagacggacggaagaccgaccggcgtagtattgtacgtgacgngtagatacggaatacgtaacgacttaccaagtaagtagacgtagggtagtatggactttgg

SEQ ID NO: 372227 - DNA, 651 bp, Homo sapiens
  misc_feature: GZ8MTXP02IRYZ8.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgtttattttagaaggtgtccagtgtgaggtgcacttggtggagtcgtgggggaggcgttggtccgacggccggggggtccctgagactctcctgtgcagtctctggacttcaccttagaagttattggatcgaccgtcgggtccgccgaggccgtaccggaggggaacggggcgtggggaggttcggggtacggacccaaaacgaaagtaaaaaccgcggaaacggaaacgtaacgaaagaaaaacctagtaggtaggtactgtaggtacgacggacccgtattaccacctactctaccgagaacgaaccaaacccgaccaaagtacttacacgttagttatttacgaacaaaagtacgaaacctacgaccgtacggaagacgggacggaacgaccgacggtacgttagtattagttgtcggacgacgtagatagagttagtacgtactacgtacgtaagacgtacgtaggtagtatgaagtttg

SEQ ID NO: 372228 - DNA, 541 bp, Homo sapiens
  misc_feature: GZ8MTXP02FEXE7.15.67.G01.1.454.CMB.2.raw
  modified_base (459)..(459): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccggggggggtccctggagactctcctgtgcagtctctggattcacccttagaagttattggatgacctgggtccgccaggctccaggggaaggggctggagtggggtggccaaacataaaacgaaaagacggaagtcaagaaaaaccctatgtggactctgtgacggccgaattcaccatctccagagacaaacgccaaagaattcactgtatttgcaaaatgaaacngtctgagaggacgaggacacggcctgtattatgtgacgcgagatagatagactactctacgaagtagcgaggtgtatgactg

SEQ ID NO: 372229 - DNA, 528 bp, Homo sapiens
  misc_feature: GZ8MTXP02FIM78.15.67.G01.1.454.CMB.2.raw
  modified_base (306)..(306): a, c, t, g, unknown or other
  modified_base (323)..(323): a, c, t, g, unknown or other
  modified_base (369)..(369): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttggtccaggccggggggggtccctggagactctcctgtgcagtctctggattcacccttagaagttatggatgacctgggtccnccagctcagggagggcnggagtgggtggccaacataaacaaagacgaagtcagaaaaaccctntgtgactctgtgacgcgattcaccatctcagagacaaacgccaaagaattcactgtaattgacaaatgaaacagcctgagagcgaggacgtacggcgtagtatattgtgcgcgagatgatagtagactctaacaagtagacgagggtggtatagagttg

SEQ ID NO: 372230 - DNA, 605 bp, Homo sapiens
  misc_feature: GZ8MTXP02I35UX.15.67.G01.1.454.CMB.2.raw
  modified_base (376)..(376): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctgggtccgccaggctccgaggggaagggctggagtgggtggccaaacataaacgaaagacggaagtacaagaaaaacctngtaggactctagtacggacgggccgtattaccgacccatcctacccgagaacgaaccaaacgacccaaagaaacttcgaactgttaattttagactaaaatacgtaaacacgtacctggaggaggacggaacggaccgacggccggttagtaattagttgcggtcgacgggatagtagaagtaagttacgacttctaacgaagtagcgtaggtgtaagtcgtagtttcg

SEQ ID NO: 372231 - DNA, 603 bp, Homo sapiens
  misc_feature: GZ8MTXP02JZ88E.15.67.G01.1.454.CMB.2.raw
  modified_base (392)..(392): a, c, t, g, unknown or other
  modified_base (422)..(422): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggtccctgagactctcctgtgcagtctctggattcacccttagagttattggatgacctgggtcccgccaggctccgaggggaaggggctgggagtggggtggccaaacgataaaacgaaagaacggaatcaaagaaaaaccctatgtaggactntgtgacggcattcacatctcagacacaacnccaaagtaatttactagtatttagactaaatcgaaacaggtacctggaaggagggacgaacgggaccgaccgggcccgttagtatttaagttcgtcggacgacgaagagttaggaacgtaagtacggactactaagaaggttaacgacgtaaggggttgtaagtcggtacttaggtttacg

SEQ ID NO: 372232 - DNA, 558 bp, Homo sapiens
  misc_feature: GZ8MTXP02IQ561.15.67.G01.1.454.CMB.2.raw
  modified_base (379)..(379): a, c, t, g, unknown or other
  modified_base (456)..(456): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggctttgtccaggccgggggggtccctgagactctcctgtgcagtctctggattcacccttagaagttattggatgacctgggtccgccaggctccgaggggaaggggctgggaggtgggtcggccaaacataaacaaagacggaagtacagaaaaacctnagtgactctgtgacggcattccgaccatcgtccagacgacacgaccaagaattcactgtatttgacgaaatgaaacngcctagagaggcggagaccgacgggccgtgtaattagttgtgcgacgagatggaatagtacgactaccttagaagtacgcgtaaggtggtaatcgaagtttg

SEQ ID NO: 372233 - DNA, 616 bp, Homo sapiens
  misc_feature: GZ8MTXP02IUE9Z.15.67.G01.1.454.CMB.2.raw
  modified_base (447)..(447): a, c, t, g, unknown or other
  modified_base (457)..(457): a, c, t, g, unknown or other
  modified_base (477)..(477): a, c, t, g, unknown or other
  modified_base (493)..(493): a, c, t, g, unknown or other
  modified_base (502)..(502): a, c, t, g, unknown or other
  modified_base (523)..(523): a, c, t, g, unknown or other
  modified_base (534)..(534): a, c, t, g, unknown or other
  modified_base (552)..(552): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttgggtccggcggggggtcccggtcgagactcctctgtgcagtctctggattctacccttagtaagttattggtatgaccgtcggtccgccaggcgtccgagggaggggcgtggaggtggtggacaacaactaaacgaaaagacggaaagtacaaagaaaactaagtgtaggactactgtacggacggcggtacttacgacctactcctaccagagaaacccganaacccgaaanaaacgtttccaattacggtntttagacgaaaatganaacggtccnggtaaggagggcgaacggganaccccggggtntagttatttagtggacgngagtatagtgtaatacgtaaacgtccaacttagtaagaagcggttaggtggtatgtactgtttc

SEQ ID NO: 372234 - DNA, 621 bp, Homo sapiens
  misc_feature: GZ8MTXP02I467U.15.67.G01.1.454.CMB.2.raw
  modified_base (344)..(344): a, c, t, g, unknown or other
  modified_base (379)..(379): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtctgggggaggcttggtccaggccgggggggtccctgagactctcctgtgcagtctctggattcacccttagaagttatggatgacctgggtccgcaggctccgaggggaaggggctgggagtggggtggcccaaanataaaacgaaagacggaagtacgaaagaaaaactnaggtggacttctggtacgaccggggcctaagttccaacccagtctacccgagaaacgaccgaaaccgtcccaaaaggtacttacacttcggttaattttgactaaaatagaaacacgacccttggaaggagggaccggaaggaaccgacgggtcccgtgttattagttgtaggccgtagaggagtagaagtaggttagaccttactacgtaagtacgacgtagggtggtaatggtactttgg

SEQ ID NO: 372235 - DNA, 715 bp, Homo sapiens
  misc_feature: GZ8MTXP02GGIVH.15.67.G01.1.454.CMB.2.raw
  modified_base (308)..(308): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggaggcttggtccgagggccggggggtcctgagactctcctgtgcagtctcgtggacttcaccttagagttattggatgaccgtgggtcccnccgaggctaccgaggggaacgggcgtgggaggtggggtcggaccaaactaaataaaacgaaaggaacggaagtaacaaagtaaaaacccgtatacggtaggaccttcgtaggtacgaccgggtccgtaacttaccaacctacgttacctaccgaaaggaaccgaaaccgaaacccgaccgaaaagtaactttccgaacttgttaactttaggaaactaaaagtacgaaaaccgtacgaccgttaagggaacggacgggaacgggaacgaacccggaacggggtccgtttaagttaacgttaagttcggtacggaccggtaacggtaagtagtaaggtaaaccgttaaggtaccgtaactactaaggaaagttacgacggttaggggtagtagtacggtaagtttcgg

SEQ ID NO: 372236 - DNA, 662 bp, Homo sapiens
  misc_feature: GZ8MTXP02JCGTU.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggatcacccttagagttatggatgaccgtggtcccgccaggcctccgaggggaagggcgtgggaggtggggtcggaccaaacaagtaaaacgaaaggaacggaaagtacaaagaaaaacctagtaggtaggaactctaggttcgaaccggggcctaacgttccaacctatccctaccaaggaacgaaccgaaaccggaccctaaaacgtaaacttaccgaacttagttaattttagtaactaaaatacgaaacaacggtaccgagggaggaacgggacgggaaacggaccgaaccgggccggttagttagtttaagttggtacgcggtacgaagtagtacggaatagtacgaaccgtctaacgaagtacgacgagggttgtacgtgtaagtttg

SEQ ID NO: 372237 - DNA, 616 bp, Homo sapiens
  misc_feature: GZ8MTXP02F6GJM.15.67.G01.1.454.CMB.2.raw
  modified_base (303)..(303): a, c, t, g, unknown or other
  modified_base (376)..(376): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggagtcgtgggggaggcttggtccaggccgggggggtccctgagactctcctgtgcagtctctggattcaccttagaagttattggatgacctgggtccnccaggctccgaggggaggggctgggagtgggtggccaacaataaaacaaagacggaagtacaagaaaaacctntgtacggactcgtggtgaaccgggccgaattccgaccctatcctacccgagaacgaaccaaaccggacccaaagaacttcacgtagttatttagactaaatgaaacacgtcctaggagaggacggaacggaccgacgggaccgttagtaagtttagttggtaggccgtacggaagagtaggtaaattaggtaacgtacttacgtaaacgaagtagacgtagggtggttactggatttcgg

SEQ ID NO: 372238 - DNA, 577 bp, Homo sapiens
  misc_feature: GZ8MTXP02G79XS.15.67.G01.1.454.CMB.2.raw
  modified_base (324)..(324): a, c, t, g, unknown or other
  modified_base (335)..(335): a, c, t, g, unknown or other
  modified_base (503)..(503): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactcctcctgtgcagtctctggattcacccttagaagttatggatgacctgggtccgcaggctcgagggaggntgaagtgggtnaccaacataaacaaagacggaagtacgaagaaaaacctagtgtaggactcgtaggtacgacgggccgattccgacctatcctacagacgacaacgacaaagaattcactgtattgacaaatgaaacagaccgtagaggaggacggaggaccgacgggccgtagtattntggtgacggacgagatgtaagtagtaacgacttcgtaacaaggtaggacgtagggttaggtagtgtagtttagg

SEQ ID NO: 372239 - DNA, 697 bp, Homo sapiens
  misc_feature: GZ8MTXP02JHI0W.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgagtgcacgttggtggagtcggtgggggaggtcgttggtccgagggcccgggggggtccctggagactctccgtgtgctagtctcgtggtattccaccttagaagttattggatgaccgtgggtcccacgaggcctacggaggggaagggctagggagtggggtcgaccaaagaataaaacgaaaggaacggaagtacaaaagtaaaaaccgtgtagtaggactcgtaggtaacgaccgggccgtaattccgactactcctaaccgagaaacgaacaaaccgaaccgaaaagtaacttaccaattgttaactttacggaaactaaagtacaaacgacgtacgtacggaagggacggacggaaggaaccgacgggtaccgttaggttaatttacgtttagggacggtccgtaacggagtaaagtacgtaaagttaaacggtaacgtaaccttaacgtaaagtaacggttaacgacggtaaacgggttgtaagttacggttagtttacgg

SEQ ID NO: 372240 - DNA, 729 bp, Homo sapiens
  misc_feature: GZ8MTXP02F0M6Y.15.67.G01.1.454.CMB.2.raw
  modified_base (344)..(344): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggagtcgtgggggaggcttggtccaggccggggggtccctgagactctcctgtgcagtctctggacttcaccttagagttatggatgaccgtgggtccgccgaggctccgaggggagggcgtggaggtgggtcgaccaaanataaaacgaaagaacggaagtaccgaaagaaaacctagtagtagaacttgtacggttacgggaccgggaccgtaacgttaccaaccctaactaccgtacccgaaagggaaaccgaaacccgaaaaccggaccctaaaaaggtaaaccttttaccgaaaccgtttagtttaaatttttacggaaaccctaaaagttacggaaaactacggtacccgtagggaacggaagggggacccggtaaaggggaacccgaccgggtaccggtttaaggttaactttaagttcggtacggcgtacggaagtagtcggtaaagtaggtaaccgtaacgtcttaaacggaagtaaaccggggcgttaaggggttaggttataccgggtatttcgg

SEQ ID NO: 372241 - DNA, 546 bp, Homo sapiens
  misc_feature: GZ8MTXP02ITL2F.15.67.G01.1.454.CMB.2.raw
  modified_base (449)..(449): a, c, t, g, unknown or other
  modified_base (454)..(454): a, c, t, g, unknown or other
  modified_base (459)..(459): a, c, t, g, unknown or other
  modified_base (467)..(467): a, c, t, g, unknown or other
  modified_base (469)..(469): a, c, t, g, unknown or other
  modified_base (491)..(491): a, c, t, g, unknown or other
  modified_base (495)..(495): a, c, t, g, unknown or other
  modified_base (520)..(520): a, c, t, g, unknown or other
  modified_base (526)..(526): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcattggtggagtcgtgggggaggcttggtccaggcccgggggggtccctggagactctcctgtgcagtctctggattcacccttagaagttattggatgacctggtccgccaggctccaggggaagggctggagtgggtgccaacataaacaaagacggaagtacaagaaaaacctatgtagactctagtcgaccgggccgtattccacccgtatctaccgagacgacaacgaccaaagaattcatgtatttnacaangaacngcctgagngngagacgacggcgtgtattatgngcgngagagtgaatagtacgactgtaacngtacgntagggtgtagtgtatttacg

SEQ ID NO: 372242 - DNA, 537 bp, Homo sapiens
  misc_feature: GZ8MTXP02I653P.15.67.G01.1.454.CMB.2.raw
  modified_base (204)..(204): a, c, t, g, unknown or other
  modified_base (300)..(300): a, c, t, g, unknown or other
  modified_base (326)..(326): a, c, t, g, unknown or other
  modified_base (340)..(340): a, c, t, g, unknown or other
  modified_base (364)..(364): a, c, t, g, unknown or other
  modified_base (372)..(372): a, c, t, g, unknown or other
  modified_base (427)..(427): a, c, t, g, unknown or other
  modified_base (429)..(429): a, c, t, g, unknown or other
  modified_base (431)..(431): a, c, t, g, unknown or other
  modified_base (433)..(433): a, c, t, g, unknown or other
  modified_base (435)..(435): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggnggagtcgtgggggaggcttggtccaggccgggggggtcctgagactctcctgtgcagtctctggattcaaccttagaagttatggatgactggccncaggctcaggggaggctggagtgggngaccaaagataaanaaagacgaagtcaagaaaaacctntgagactnagtacgacggccatacaccatcacagagacaagacctaaagattcatgattgaanananananacagagagacgagacgacgacgtagtagttagtagtagcgacgagagtagtagtaagtacgtactactaacgtaagtagacgtaggtagtacgtagtagtag

SEQ ID NO: 372243 - DNA, 621 bp, Homo sapiens
  misc_feature: GZ8MTXP02FV1U6.15.67.G01.1.454.CMB.2.raw
  modified_base (590)..(590): a, c, t, g, unknown or other
  modified_base (594)..(594): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacgttggtggagtcgtgggggaggcgttggtccgagggccggggggtccctggagactctcctgtgcagtctctggattcacccttagagttattggatcgaccgtgggtccgccgaggcctccgaggggaaggggcgtgggaggtggggtggaccaaacaataaaacgaaaaggacggaaagtacaaagaaaaacctagtagtaggactcgtgtacgacggccgacttcaccatctaccagacgaacaaaccgaccaaagaaattacctatacgttaatttcgactaaaatgaaaacacgaccgtaggaacggagggacgggaacggaaccgaccggggtaccgtagtttaatttagtagttggcgtacggagagtagatagtacgtactntaanaacgtagcgtaggtagtatgtatttgg

SEQ ID NO: 372244 - DNA, 606 bp, Homo sapiens
  misc_feature: GZ8MTXP02IN88K.15.67.G01.1.454.CMB.2.raw
  modified_base (541)..(541): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttatggatgacctgggtccgccaggctccgaggggaaggggctgggaggtgggtggaccaacaataaacgaaagacggaagtacaagaaaaacctatgtaggactctgttacgacgggtcattccgacctatctacagaagacaaaccgacaaagattacatacgttatttgaactaaatgaaaactagacctaggaaggacgggtacggaaagggacccgacggggccgttagtacttagttggtgcgacggagtanaggtaagtaaggtacgaaccttataccgtaaggtacgcgtaagggttcggttatagaacgtttgg

SEQ ID NO: 372245 - DNA, 778 bp, Homo sapiens
  misc_feature: GZ8MTXP02IKNKO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgtttatttagaaggtgtccagtgtgaggtgctacgttgggtggaggtcggtgggggaggtcgtttcgggtccgacggggccccgggggggttccctggacgtaccttcctcctgtgcagtctcgtggtattcctaaccttagaagttattggatcgaccgtcgggtcccgccgaggcctaccggaggggaacggggctggggaggtgggtacggaccaaaacgaaagtaaaacgaaaggaacggaagtaacgaaaagtaaaaccgttagtggtacggtaacttcgtaggtaacgggaccgggtcctaacttaccctaacccgtccttacctaccgaacgaaacgaccgaaacccgtaccaaaagtacttaccgtacgttacgtttaaatttcgaaactaaaagtacgaaaaccgtcgtacccgtagggaacgggagggacggaacggacccggtacggtacggtttagtttaacgtttgttacggtacggtcggtaacggtaaggttagttacggtaaaggttaaacgtacgtaaaccgttaccgtaaaacggtaagggttaacggtacgggttacggggtttagtaaaccggtttacggtaagttttacgg

SEQ ID NO: 372246 - DNA, 770 bp, Homo sapiens
  misc_feature: GZ8MTXP02I232H.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggaggttggggctgagcttgggttttccttgttgtttattttagaaggtgtccagtgtgaggtgctacgttgggtggaggttcggtggggggaggtcgtttgggtcccgacggggtccccgggggggttcccctggacgtaccttccgtcccgttggtcgctagttccttcgtggtaacttccctaaccctttaaggaagtttaatttgggatcggtaccgttcggggtccccgccgacggcctacccgaggggggtaaacggggtcgttggggaaggttggggtcggacccaaaacaagtaaaacgaaaagggaacgggaaagtacgaaaagaaaaaacccttgtagtaggaaccttctacgggttagacccggggtccctaagtttacccaaccctattcctacccaaaggaacgacaaacccgacaaaagtaacttacaacttggttaaattttcgaacctaaaagtcgaaaaccaggtaccgttaggaaggaacgggacgggaaaccggaccgtaccggggtcccgttaggttaaactttaggtttacggcgacggtacggagtagtaggtaaccgtaaggtacgtaactcgttaagaaggttacgacgtaggtgtaagttcgagtttcgg

SEQ ID NO: 372247 - DNA, 706 bp, Homo sapiens
  misc_feature: GZ8MTXP02JJN18.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggaggtcgtgggggaggtcgttggtccgagggtcccgggggggtccctgagactctcctgtgcagtctcgtggtacttcctaccgttagtaagttatggagtcgaccgtcggtcccgcgacggccgtaccggaggggaacggggtcgtagggagggtcgggtacggacctaaaacgaaacgtaaaaaccgaaaaggtaaaccgggaaagtaaccgaaaaagtaaaaaaccgttgtaggtacgtacgttcgtaggtacgtaccggtaccgtactacccgtaccactccgtacgaacggaacgaaccgaaaccgacgtaaagtacttactacgttagttaacgttacgactaaacgtacgaaacgtcgacgtagggacggaagacgggacggaccgtacggtcgtagttagttcggtagtcgacggactaggtagtaacggtagttacgacgtaccgtacgtaagtaagtacggtacggtaggttagtcgtaagtcgtttaagg

SEQ ID NO: 372248 - DNA, 584 bp, Homo sapiens
  misc_feature: GZ8MTXP02JP3TW.15.67.G01.1.454.CMB.2.raw
  modified_base (335)..(335): a, c, t, g, unknown or other
  modified_base (388)..(388): a, c, t, g, unknown or other
  modified_base (487)..(487): a, c, t, g, unknown or other
  modified_base (516)..(516): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttatttagaaggtgtcagtgtgaggtgctattgggtggagtcggtgggggaggtcgttgggtccgagggcccgggggggtccctggagacctctcctgtgctagtctcgtggacttcaccttagaagttatgatgacctggtcgccagctccgaggggaagggtcngggagtgggtgaccaagaaataaacgaaagacggaaagcaaagaaaaaccctntaggtagactcgtggtacgaccggcgattaccaccatctaccagacgaacaaacgacaagtaattcaacttgtattagaacaaatagaacagctagagnggacggagaccgaggacgtgtatagttgngcgacgagtatagacgtaagtacgtactacgaacgtaaggtacgacgtagggtagtagtagtacgttg

SEQ ID NO: 372249 - DNA, 584 bp, Homo sapiens
  misc_feature: GZ8MTXP02IA30F.15.67.G01.1.454.CMB.2.raw
  modified_base (311)..(311): a, c, t, g, unknown or other
  modified_base (538)..(538): a, c, t, g, unknown or other
  modified_base (560)..(560): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggctttgggtccgaggcccgggggggtccctggagacctctcctgtgcagtctctggattcacccttagaagttatggatgacctgggtccnccaggctccgaggggaagggctgggagtgggtgccaaacataaaacaaaggaacggaagtacaagaaaaacctatgtaggactcgtggtagaccgggccgaattaccgacccacgtctacccaagaacgacaaacccgccaaaggaacttcaactgttatttacgactaaatgaaacacgcctagagaggcggaggacacggccgtagtattagttagtgcgagagntagataagtacgactctaacgngtagcgaggtgtagtacgagttgg

SEQ ID NO: 372250 - DNA, 665 bp, Homo sapiens
  misc_feature: GZ8MTXP02JTKUU.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggtcgttgggtccgagggcccgggggggtccctggagactctcctgtgctagtctcgtggattcacccttagaagttatggatgaccgtgggtccgccgaggctccgaggggaggggctgggaggtggggtggaccaaacaataaaacgaaaggaacggaagtacaaagaaaaacctgtgtaggactgtagtagaccggccgattaccaacctatcctacccaaggaacgaacccgaaacgacccaaagtaacttacaacttgttactttagactaaaagtagaaacacgctacggaggacgggacggaaggaaccgacgggtacccgttaggtaatttagtggtcgacggtacggaaaggtagtaggtaaagttaacggtaacgtaccttaaccgtaaagtaacgtaacggacggtaaggggtaggttaacttaggtaacgttttgg

SEQ ID NO: 372251 - DNA, 668 bp, Homo sapiens
  misc_feature: GZ8MTXP02H6PXM.15.67.G01.1.454.CMB.2.raw
  modified_base (285)..(285): a, c, t, g, unknown or other
  modified_base (301)..(301): a, c, t, g, unknown or other
  modified_base (337)..(337): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcattggtggagtcgtgggggaggcttggtccagggcccggggggtccctggagactctcctgtgcagtctctggattcaccttagattntggatgacctgggtcnccaggctcgaggggagggctggagtgggtgaccaanataaacaaagacggaatcgaaagtaaaaacctatgtaggacttcgtaggtacgacgggtccgtaattccgaccatcctccaagacgacaaccgaccaaagtaacttacaacgttgttaattttacgaactaaaagtagaaaacacggacccgttagggaaccggaaggggacccggaacggggtaaaaccgccgggggtccttaaggttaaagtttaggttagggttcgccgggtacgaagggtattcgggaaaattaaggggttacgtaaccgttacttaaaccgaaggtagtaccggtaaaggggttagtaacggttagaacgttttgg

SEQ ID NO: 372252 - DNA, 568 bp, Homo sapiens
  misc_feature: GZ8MTXP02FK3GZ.15.67.G01.1.454.CMB.2.raw
  modified_base (544)..(544): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcaccttagaagttattggatgacctgggtccgcaggctccgaggggaaggggctggagtggggtggccaaacaataaaacgaaaagacggaagtacaaagaaaaacctatagtggactctgtaggaccggccgattcaccatctccaagagacaaacgccaaagattccatgtatttgacaaaatgaaacagacctagagaggcgaaggacccgaacgggccgtgtaagttgttgtagaccgacgaggatacggattagtagacctctaanaagtagcgaggtagtatagattcg

SEQ ID NO: 372253 - DNA, 787 bp, Homo sapiens
  misc_feature: GZ8MTXP02JTBTR.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggaggttggggctgagcgttgggttttccttgttgttattttagaaggtgtccagtgtgaggtgctagttggtggaggtcggtgggggaggtcgttggtccgagggcccggggggtccctggacgactcctcctgtgcagtctcgtggattccaccttagaagttatggatcgaccgtgggtcccgccgtacggcctccggaggggaacggggcgtggggaggtcggggtacggacccaaaactaaagtaaaaacgaaaggaaacggtaaagtaaccgaaaagaaaaacctagtagtacggtacttcgtaggtcggaccgggtccgtaacttccaacctactaccgtaccaacggaaacgaaccgaaaaccgacccgaaaacgtaaacttaccgtaacctttaagttaacgttttacgaactaaaacttacggaaaccgaaacggtccgtaagggaaggggaacgggaccgggtaaacgggaacccggtacccggggtaccggttacgttaaagttaacggtttcgggtagacccgggtacgggtaagtaagtacggtaaagttaaacgggttaacgtaacccgttacgtaaacggaaggttaacggtacgggtaacggggttaggtttaagtacggggttaatttacgggg

SEQ ID NO: 372254 - DNA, 577 bp, Homo sapiens
  misc_feature: GZ8MTXP02GFNDP.15.67.G01.1.454.CMB.2.raw
  modified_base (303)..(303): a, c, t, g, unknown or other
  modified_base (376)..(376): a, c, t, g, unknown or other
  modified_base (416)..(416): a, c, t, g, unknown or other
  modified_base (436)..(436): a, c, t, g, unknown or other
  modified_base (447)..(447): a, c, t, g, unknown or other
  modified_base (495)..(495): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcattggtggagtcgtgggggagcttggtccaggccgggggggtccctggacgactctcctgtgcagtctgtggattcaccttagagttattggatgacctgggtccncagctcgagggagggctggagtggtgcaacagtaaacaaagacgaagtcaaagaaaacctgtgtggacttcgngtacgacggcgattcgaccatcctaccagacgacaaaccncaaagattccatgtattganaaatgaaacanccgtgaagagacggagaccgacgggtctagtagttagttgtcggacgngagtagttacgaaagttagtaaccgtaactccgttaaagaacggttaagaccgttaggggtaggttactggtaacgttttgg

SEQ ID NO: 372255 - DNA, 572 bp, Homo sapiens
  misc_feature: GZ8MTXP02FY4KP.15.67.G01.1.454.CMB.2.raw
  modified_base (378)..(378): a, c, t, g, unknown or other
  modified_base (520)..(520): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccgagggccggggggtccctgagactctcctgtgcagtctctggattcacccttagaagttattggatgaccgtggtccgccaggctccgaggggagggctggagtgggtgccaaacataaaacgaaagacggaagtacaagaaaaacctntgtagactctagtagaccgggccaattcgaaccatactccgaagacgaaccaaacgacccaaagaacttacactagttatttgactaaaatgaaacagcctagagagacggagaccgcggccgtagtattatgtgcgcgagntagatagtacgtactcgtaacgaagtacgacggtaggtgtacgtgagtttgg

SEQ ID NO: 372256 - DNA, 580 bp, Homo sapiens
  misc_feature: GZ8MTXP02FNOYG.15.67.G01.1.454.CMB.2.raw
  modified_base (433)..(433): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggccgggggggtccctggagactctcctgtgcagtctctggattcacccttagaagttattggatgacctgggtcccgcaggctccgaggggaaggggctggagtggggtggaccaaacaataaaacaaaaggacgggaaagtacaaagaaaaacctataggaggactcgtgtgaccggccgattaccaccatctccaaganacaaacgacaaagaattcactgttatttagactaaatagaaacagcctaggagaggacggaagacgacggccgtagtattagtgtgcgacgagatcgaattaacgacgaactcgtacaagtagacgtaggtaggtatacggatttgg

SEQ ID NO: 372257 - DNA, 699 bp, Homo sapiens
  misc_feature: GZ8MTXP02IW5DZ.15.67.G01.1.454.CMB.2.raw
  modified_base (638)..(638): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagtcgttgggttttccttgttgtttattttagaaggtgtccagtgtgaggtgctacgttgggtggagtcggtggggggaggtcgtttgggtccggacgggtcccgggggggttccctggacgaccttctccgtgtgctagtctctggacttccaacccttagaagtttattggatcgaccgtcgggtcccgccgaggccgtaccggaagggggtaacgggcgtaggggaggtggggtacggacccaaaacgtaaacgtaaaaacgaaaggaaacggtaaagtaccgaaaagaaaaaacccttgtaggtacggaacttcgtaggtacggaccgggtcccgtattacccaacctactcctacccaagaacgaccaaaccgaccaaagtacttacgacttagtatttacgacaaatcgaaacagtccgtaggaaggacgggacggaacggaccgaccggtcgtttaagtagttaagttggtgacgtacgagtntaggtaagtagtacgactacgtaagaagtaggtacgtaaggttgtaacgtggtatttacgg

SEQ ID NO: 372258 - DNA, 605 bp, Homo sapiens
  misc_feature: GZ8MTXP02GKQ4I.15.67.G01.1.454.CMB.2.raw
  modified_base (314)..(314): a, c, t, g, unknown or other
  modified_base (394)..(394): a, c, t, g, unknown or other
  modified_base (441)..(441): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgtttattttagaaggtgtccagtgtgaggtgcacttggtggagtcgtgggggaggtcgttgggtccgagggcccgggggggtccctggagactctcctgtgcagtctctggattcacccttagaagttattggatgacctggggtccnccaggctccgaggggaaggggctggaggtggggtggaccaaacaataaaacaaaggacggaagtacaaagtaaaaacctntggtggaacttctaggtagaccgggccgattccaccatcctacaganacacgccaagaatcactagtattgtacaaatagaaacacgtccgagacggaggacgggagaccgacggccgtgtattattgtgacggtcgagagtagtagtaacggtagaccgttctaaccgtaaggtaacgtacggtacggttaggtaggtcgtaagtttcgg

SEQ ID NO: 372259 - DNA, 747 bp, Homo sapiens
  misc_feature: GZ8MTXP02IYPZX.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgctacgttgggtggaggtcggtgggggagggtcgtttcgggtccgacgggtccccgggggggtccctggacgtacctcctccgtggtgcctagtcttcgtggtacttcctaacccttaagtaagtttagttggatcgtaccgtcggggtcccgccgaacggccgtaccggagggggaacggggcgtaggggaggtggggtacggacccaaaacgtaaagtaaaaaccgaaaaggaaaccgggaaagtaaaccgtaaaaggtaaaaaacccgttagtaggtacggtaaccttcgttacggaacggaccgggtaccgtaactttaccgaaccctagtcctaccgaagaacgaaccaaaccgacccaaaaggtaacttcgtaacgttagtttagtttagaactaaagtagaaaccgacgtaccgtaggaaggacgggacggaaacgggacccgtacgggtccgttagttagtttattgggcgtacgtacggaggtataggtaacgttagtacgtactacgtaacgaagtacgacggtaggtagtagtagtactttg

SEQ ID NO: 372260 - DNA, 559 bp, Homo sapiens
  misc_feature: GZ8MTXP02ITYT3.15.67.G01.1.454.CMB.2.raw
  modified_base (261)..(261): a, c, t, g, unknown or other
  modified_base (304)..(304): a, c, t, g, unknown or other
  modified_base (457)..(457): a, c, t, g, unknown or other
  modified_base (461)..(461): a, c, t, g, unknown or other
  modified_base (478)..(478): a, c, t, g, unknown or other
  modified_base (493)..(493): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggcccggggggtccctgagctctcctgtgcngtctctggattctaccttagaagttatggatgacctgggtccnccgaggctccaggggagggctggagtggtgccaacataaacaaagacgaagtacaagaaaacctatgtaggactcaggtacgacgggccgatccgaccatctacgagacgacaaacgccaaagaacttcacttgtaatttgacaaatgaaacngccnggacgaggacgagaccncggcgtgtattatgngcggcgagactgaatagtacgtacgtactaacgtgtacggtacgaggttggtaacgtgtatttcgg

SEQ ID NO: 372261 - DNA, 745 bp, Homo sapiens
  misc_feature: GZ8MTXP02GH1A1.15.67.G01.1.454.CMB.2.raw
  modified_base (397)..(397): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgagtgcacttggtggagtcgtgggggaggtcttggtccgaggcccggggggtccctgagactctcctgtgcagtctctggtattcaccttagagttattggatgaccgtcggtccgccgaggctccggaggggaaggggcgtaggggaggtggggtcggacccaaaacgaataaaacgaaaaggacggaaagtacaaagaaaaacctntaggtgaactctggtacgaccgggccgtagttaccaccataccctaccgaacgaacgaaccgaaaacccgaccaaaagtaacttacctacgttaggttaatttttacgaactaaaacgttacgaaaaccgtacggtacccgttagggaagggaacggggaaccgggaacgggaacccgtaaccggggtccggtttaacggtttaacgtttaacgttggggttacgaccgggtacggaaggttagtaacggtaacgttaaaggtacgggtaacctacccggtttaaacgaaacggtttacggacggtaaaacgggggttggtttaaacggtcgggtttaattttcgggg

SEQ ID NO: 372262 - DNA, 597 bp, Homo sapiens
  misc_feature: GZ8MTXP02JJ375.15.67.G01.1.454.CMB.2.raw
  modified_base (331)..(331): a, c, t, g, unknown or other
  modified_base (385)..(385): a, c, t, g, unknown or other
  modified_base (390)..(390): a, c, t, g, unknown or other
  modified_base (396)..(396): a, c, t, g, unknown or other
  modified_base (467)..(467): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccagggcccgggggggtccctggagactctcctgtgcagtctctggtattcacccttagaagttattggatgaccgtgggtccgcaggctcgaggggagggcgnggaggtggtgaccaacgaataaaacaaacggacggaagtacgaaagaaaacctntaggngacctntggtagacggccgtattccacatctcagacgacacgacaaagatcgactgttattagactaaatcgaaacncgactaggaggacggacgggaagacccgacgggtaccgtaggttacgttagttcgtagccggtacgagtaagtcggaaattaacggtacacgttactacgaagtagacgtagggtagtacgtgtaagttg

SEQ ID NO: 372263 - DNA, 569 bp, Homo sapiens
  misc_feature: GZ8MTXP02GKF8C.15.67.G01.1.454.CMB.2.raw
  modified_base (377)..(377): a, c, t, g, unknown or other
  modified_base (450)..(450): a, c, t, g, unknown or other
  modified_base (460)..(460): a, c, t, g, unknown or other
  modified_base (463)..(463): a, c, t, g, unknown or other
  modified_base (465)..(465): a, c, t, g, unknown or other
  modified_base (468)..(468): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttttagaaggtgtccagtgtgaggtgcacttggtggagtctgggggaggcttggtccagccgggggggtccctgagactctcctgtgcagtctctggattcacccttagaagttattggatgacctggggtccgccaggctccaggggaaggggctggagtgggtggccaaacataaaacaaagacggaagtacagaaaaaacctntacgtggaactctgtagaacggggccattcaacccagtctaccagacgacaaacgccaaagaaattccaagtntatttcgaanaananaanagacagagaggacgagacgacgacgtagtattatgtgcgacgagagtagtagtaagtacgtactactactaagtacgacgtacggtagtacgtacgtagtg

SEQ ID NO: 372264 - DNA, 551 bp, Homo sapiens
  misc_feature: GZ8MTXP02F5AEK.15.67.G01.1.454.CMB.2.raw
  modified_base (305)..(305): a, c, t, g, unknown or other
  modified_base (408)..(408): a, c, t, g, unknown or other
  modified_base (416)..(416): a, c, t, g, unknown or other
  modified_base (450)..(450): a, c, t, g, unknown or other
  modified_base (495)..(495): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagagttatggatgacctgggtccncaggctccgaggggaagggctgggaggtggggtggccaaacataaaacaaaggacggaagtacaaagaaaacctatgtagactctgtgacgggcgattcaccntctcaganacacgcaaagatcactgtattgacaaatgaaacngcctgagaggcgagaccaggccgtgtatatgtcgcgtacgagtancgtaataggtacgtactctaagaagtaagacgtaggggtagtagtcgtaagtttgg

SEQ ID NO: 372265 - DNA, 561 bp, Homo sapiens
  misc_feature: GZ8MTXP02JX6NT.15.67.G01.1.454.CMB.2.raw
  modified_base (381)..(381): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactgtcctgtgcagtctctggattcacccttagaagttattggatgacctgggtccgccaggctccgaggggaaggggctgggagtggggtggccaacgataaaacaaaggacggaagtcaagaaaaaccctntagtggactctgtcgacggccgattccaccatctaccagagacaacgcaaagatcactgtatttgacaatgaacagcctgagaggacgaggacacgggccgtagtattagttgtgcgtcggagatagtaataggtacgacttacgtaacgaagtacgacgtaggtggtaagtcgatttgg

SEQ ID NO: 372266 - DNA, 579 bp, Homo sapiens
  misc_feature: GZ8MTXP02IS0KD.15.67.G01.1.454.CMB.2.raw
  modified_base (307)..(307): a, c, t, g, unknown or other
  modified_base (333)..(333): a, c, t, g, unknown or other
  modified_base (340)..(340): a, c, t, g, unknown or other
  modified_base (372)..(372): a, c, t, g, unknown or other
  modified_base (379)..(379): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttgggtggagtcgtgggggaggcttggtcccgaggcccgggggggtccctgagtactctcctgtgcagtctctggattcaccttagaagttattggatgacctggtccncaggctcgagggagggctggagtggnggccaanataaacgaaagacgaagtacaagaaaacctangtgactntgtacgacggcgattcacctgtactccagacgacaaccgacgaaagtaacttacaacttgttattttagaccaaaatgaaacacgacctaggagacggacgaagggacacggcgtgttaattattggagccgaggagtagtgtaaagtacgtacgactccttaagaaggttagacgtaggggtggtaagttgacgtttag

SEQ ID NO: 372267 - DNA, 589 bp, Homo sapiens
  misc_feature: GZ8MTXP02JBG2R.15.67.G01.1.454.CMB.2.raw
  modified_base (314)..(314): a, c, t, g, unknown or other
  modified_base (350)..(350): a, c, t, g, unknown or other
  modified_base (382)..(382): a, c, t, g, unknown or other
  modified_base (467)..(467): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggtcgttgggtccgagggcccgggggggtccctggagtactctcctgtgctagtctcgtggattcacccttagaagttatggatgacctggtccncaggctccgaggggagggctggagtgggtggccaanataaaacaaagacggaatacaagaaaaacctntagagactctggtagaccggggtccattccgactatctaccagacgacaacgaccaaagactcactgtatttgacaaatgaaacngtacctagagaggcgaagaccgacggccgttatacgtattaggtcgcgtacgagagtaggtaataccggttaaacaccgttacgaacgtaaggtacgtacggtaggtagtacgtagtacgtg

SEQ ID NO: 372268 - DNA, 674 bp, Homo sapiens
  misc_feature: GZ8MTXP02GXURH.15.67.G01.1.454.CMB.2.raw
  modified_base (490)..(490): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttgggtccaggccgggggggtccctgagactctcctgtgcagtctctggattcacccttagtaagttattggatgaccgtgggtccgccgaggctccgaggggaagggctggaggtgggtggaccaacataaacgaaagacggaagtacaagaaaaacctagtgtaggactcgtggtacgacgggccgattccaaccctattacaccgagaacgaccaaaccgaccaaaggaacttcaacgttgtatttacgactaaacgtgaaaacncgaccgtagagggacggacccggaaggaacccgacgggtacccgttagggttaaactttaaggttccggttaaggcccggtaacgaagtaaggtaccgtaagttaagggtttaacgaaaccttccgttaaaccgtaaggaaagtaccggtaaaggggtggtttaacgtccggtaatttaccggg

SEQ ID NO: 372269 - DNA, 676 bp, Homo sapiens
  misc_feature: GZ8MTXP02GDFIC.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtggaggtgcacttggtggagtcgtgggggaggcttgggtccgaggccgggggggtccctgagactctcctgtgcagtctctggattcacccttagaagttattggatgaccgtgggtcccgccaggcctccgaggggaacggggctgggaggtggggtcggaccaaacaataaaacaaaaggaaccggaaagtacaaaggaaaaaacctagtgtagggaccttcgtggttagaaccgggccgaattaccaaccattcctaccgaagaagaaccaaacgacccaaaagaacttacaacgtgttaatttgacaaaagtgtaaaacagtaccctaggaagagggaccggaaggaaacccgaccgggtaccgttagtaatttaagttggttacggcggtaccggaagtaagtggaaacgttaaggtacgtaaccttaacgttaaacccgaagtttaacggacgttaggggtaggtaatacgtaagtttcgg

SEQ ID NO: 372270 - DNA, 716 bp, Homo sapiens
  misc_feature: GZ8MTXP02I5WMB.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccgaggcccggggggtccctgagactctcctgtgcagtctcgtggattccacccttagagttagtggatgacctggtccgccaggctccgaggggagggctgggagtgggtgaccaacgataaacaaagacggaatacgaaagaaaactatagtgactctggtacgaccggccgtattccaaccctatcctaccgagaacgacgaaacccgacccaaaaggtaacttccgtaacgttacggtttactttacggaactaaaattacggaaaaccgtaacggtaccgttaacgggagggaaacggggaccgggaaaacggggaaaccccgggaacccggggtacccgggttagtttaaaacgtttacggttttaaggtcgggtaccgggtacggaaggtagttacgggtaaaattaacgggttaaacgtaacgttaccgtaaacgtaacggtacgggaacgttagggggttagtaacgtgtaacgttttacgg

SEQ ID NO: 372271 - DNA, 554 bp, Homo sapiens
  misc_feature: GZ8MTXP02IHZTD.15.67.G01.1.454.CMB.2.raw
  modified_base (342)..(342): a, c, t, g, unknown or other
  modified_base (422)..(422): a, c, t, g, unknown or other
  modified_base (446)..(446): a, c, t, g, unknown or other
  modified_base (452)..(452): a, c, t, g, unknown or other
  modified_base (459)..(459): a, c, t, g, unknown or other
  modified_base (469)..(469): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtcctgagactctcctgtgcagtctcgtggattcacccttagaagttattggatgacctggtccgccaggctccgaggggagggctggagtgggtggccaaanataaaacaaagaccggaagtacaaagaaaaacctataggtggactctaggtacgacggccgtattccaccatctacaganacaacgccaagattcatgtatttnacaaancgaaacngctaggaagnggacgagacgacggcctgtattagttgcgcgcgagagtgaatacgtagaccttcgaataacggtagacgaggtcgtatgtagttg

SEQ ID NO: 372272 - DNA, 709 bp, Homo sapiens
  misc_feature: GZ8MTXP02JNBHE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggtcttggtccgaggccggggggtccctggagactctcctgtgcagtctctggattccacccttaagaagttagttggatgaccgtcgggccgccgaggccgtaccgaggggaaggggtcgtggggaggttggggtcggaccaaaacgaaataaaaaccgaaaaggaacggaaagtacgaaaagtaaaaaaccgtagtaggtacgaaccttcgtaggttaacggaccggggcccgtaaacttacccaccgtactaccgtaccaaggaacgaaacaaaccggtacgaaaacgtaattaccacttaggttaatttagaacaaaagttacgaaacagtaccctaggaacggagggaccggaagggaaccgccgggaccgttaggttaagtttagttaggtacggcggtacgaggtagtacgtaagtaggtaacgtaaccgttacgtaccgaaggttacgacggtaaggggttagtacgtacggtactttacgg

SEQ ID NO: 372273 - DNA, 623 bp, Homo sapiens
  misc_feature: GZ8MTXP02JBTH8.15.67.G01.1.454.CMB.2.raw
  modified_base (268)..(268): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctggagactctcctgtgcagtctntggattcacccttagagttatggatgacctggccgccaggctccgaggggaaggggcgtggaggtggggtcggacccaaacgaataaaacgaaagacggaagtacaaaggaaaaaccctgtgtagactcgtagtacgaccgggccgtaattccgaacccataccgtacccaagaacgaacaaaccgacccaaagtaacttactaacgtgttaacttttgaactaaaagtagaaaccgagaccgtagaacgagggacggaacgggacaccgggtaccgtgttaagttatggtgaccggcgaagagtagagtagtacgactacaacgtaagtagacgtaggtagtactagacgtttg

SEQ ID NO: 372274 - DNA, 593 bp, Homo sapiens
  misc_feature: GZ8MTXP02JOVL9.15.67.G01.1.454.CMB.2.raw
  modified_base (530)..(530): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcgttgggtccgagggcccgggggggtccctggagactctcctgtgccagtctcgtggacttcaccttagaattagttggatgaccgtgggtcccgccgaggctccgaggggaacggggctgggaggtggggtcggaccaaacaataaaacgaaaggacggaagtacaaggaaaaacctgtaggtggaactgtgtgaccggccgtatccgaccatcgtaccagacgacaaacgacaaagattcactgtactttagactaaatagaaacacgcgtagaggaggcgagacgcggacgtagtattagtgtcgngacgatagtcgaatacggtatacctacgtaagtaaggtagacgtaggtggtactggtatttgg

SEQ ID NO: 372275 - DNA, 613 bp, Homo sapiens
  misc_feature: GZ8MTXP02H5IAO.15.67.G01.1.454.CMB.2.raw
  modified_base (309)..(309): a, c, t, g, unknown or other
  modified_base (349)..(349): a, c, t, g, unknown or other
  modified_base (435)..(435): a, c, t, g, unknown or other
  modified_base (471)..(471): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttattttagaaggtgtccagtgtgaggtgcacttggtggagtcgtgggggaggcttggtccgagggccgggggggtccctggagactctcctgtgcagtctctggattcacccttagaagttatggatgaccgtgggtacccnccgaggctccgaggggaagggctggaggtggggtgccaanaataaaacaaaggaacggaaagtaccaaagaaaaaacctagtaggtacgactctggtacgacggccgtatccgaccatcaccaganaccaacgacaagaatcactagtatttgaactaatanaacgacgaccgtagaaggagggcggaacgacgtacgggaccgtgtaagtttaagtttggcgaccggtcggaagtagtaggaaacgttagacgtaacttccgtaaacgtaacggtaagcgtaggtaggtataggtaactttgg

SEQ ID NO: 372276 - DNA, 714 bp, Homo sapiens
  misc_feature: GZ8MTXP02GLFX5.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcgttggtccgaggcccgggggggtccctggagactctcctgtgcagtctcgtggtattccacccttagaagttattggatcgaccgtgggtccgccgaggctccgaggggaacgggcgtgggaggtgggtggacccaaacaataaaacgaaaggaacggaaagtacgaaagtaaaaaacccgtagtaggtaggactcgtaggtacggaccgggccgtatttaccgaacctactccgtaccgaagaacgaaccgaaaccgaccaaaagtaaacttacgtaaccgttagtttaattttacggaaactaaaagtacgaaaacgacggtaccgtaggaaggaacgggacggaacgggaaccgtaccgggtccggttagttaatttaggttggtcgcggacggtaagtagtacggtaaagtaacggttaacgaccgtttaacgtaaccgtaaggttaacggacggtaagggttggttaaacgtggtaacgttttcggg

SEQ ID NO: 372277 - DNA, 633 bp, Homo sapiens
  misc_feature: GZ8MTXP02HH30U.15.67.G01.1.454.CMB.2.raw
  modified_base (307)..(307): a, c, t, g, unknown or other
  modified_base (327)..(327): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttgggtccaggccggggggtccctgagactctcctgtgcagtctctggattccacccttagaagttattggatgacctgggtccncaggctccgaggggagggcngggagtgggtggaccaacaataaacgaaagacggaaagtcaaagaaaaacctagtagtggaactcgtagtacgaccgggccgtattccgacctatcctaccaagacgaaccaaaccggaccaaagtaacttccaattggtaatttagaactaaaatcgaaacagtaccctaggaacggagggcggaaagggtacccgacggggaccgttaggttaatttagtttggacgcggtacggaaggtatacgggtaatacgggtatactacttaacgaaggtaggacgtagggtaggtatcgtagtttcgg

SEQ ID NO: 372278 - DNA, 550 bp, Homo sapiens
  misc_feature: GZ8MTXP02FS52M.15.67.G01.1.454.CMB.2.raw
  modified_base (266)..(266): a, c, t, g, unknown or other
  modified_base (302)..(302): a, c, t, g, unknown or other
  modified_base (342)..(342): a, c, t, g, unknown or other
  modified_base (377)..(377): a, c, t, g, unknown or other
  modified_base (406)..(406): a, c, t, g, unknown or other
  modified_base (520)..(520): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggaggcttggtccagggccggggggtccctgagactctcctgtgcagtctntggattccaccttagagtattggatgacctggtccnccgaggctccgaggggagggctggagtgggtcggaccaanaataaacgaaagacggaaagtacaagaaaaacctngtagactctagtagacggcattcacatcncagagacaacgccaagtacttcactgtatttgacaaaatgaaacagcctagagagggacgaggaccgacggcgtagtagttagtgtgcgtacgagatgaacgtagtacgtactntacgaagtacgcgtaggtgtagtgagtttg

SEQ ID NO: 372279 - DNA, 630 bp, Homo sapiens
  misc_feature: GZ8MTXP02I7UR1.15.67.G01.1.454.CMB.2.raw
  modified_base (308)..(308): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggtccctgagactctcctgtgcagtctctggacttcacccgttagaagttattggatcgacctgggtccnccaggctccgaggggaacgggctgggagtgggtggccaaacataaacaaaggacggaataccgaaagaaaaaccctgtaggtaggactcgtaggtacgaccggggcctaacttccgaaccctattcctaccgaaggaacgaaccaaaccggtacccaaaaggtaacttaccgaacgttggttaacttttaggacctaaaatcgaaaacacgtaccgtaggagggagggaccggaagggtaccgacgggccgttagttattagttgacgtcgagagatgaactagacgactacgtaacaagtacgacgaggtgtatgactttg

SEQ ID NO: 372280 - DNA, 735 bp, Homo sapiens
  misc_feature: GZ8MTXP02JV1BJ.15.67.G01.1.454.CMB.2.raw
  modified_base (383)..(383): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggccgggggggtccctgagactctcctgtgcagtctctggattcacccttagaagttatgatgacctgggtccgccaggctccgaggggaggggctggagtgggtggaccaacaataaacaaaagaccggaagtaccgaagaaaaaaccctntaggtaggaactcgtaggtcggaaccggggcccgaattccaaccctaatcctacccaaaggacgaaaccaaaccgaccgtaaacgtaaacttaccactttaggtaattttacggactaaaaagttcgaaaaccgaaggccccgttaggaagggaacggggtacccggggaaaagggtaaacccgaacccgggggtcccgtttaacggggttaaactttttaacggttaggttcgggtacggaccgggaaaggtaaaggttcggtaaaacgttaagggtaacgaaccggttacccttaaacgaaggtaacggtaccgtaaagggggtggttaaacgttcggaaaccgttttgg

SEQ ID NO: 372281 - DNA, 646 bp, Homo sapiens
  misc_feature: GZ8MTXP02FH7LF.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggtcttggtccgagggcccgggggggtccctggagactctcctgtgcagtctctggattcaccttagtaagttatggatgacgtggtccgccagcctccgaggggagggctgggaggtgggtcggaccaaacaataaaacgaaaggacggaaagtacaaagaaaaaccctgtgtacggactcgtagtacggaccggccgaattccaacctatacctaccaagacgaaccaaaccgacccaaagtaacttcactgttaatttacgaactaaaagtacgaaaccacgacccgtaaggaacgggagggaccgggaaaggacccgaccgggtaccgtttagttatttagttgtagccggtacgtaagagttaagaagttaagtaacgtacctacgtaacgaagtagacgtagggtagtagtacgtatttgg

SEQ ID NO: 372282 - DNA, 579 bp, Homo sapiens
  misc_feature: GZ8MTXP02JGIN0.15.67.G01.1.454.CMB.2.raw
  modified_base (330)..(330): a, c, t, g, unknown or other
  modified_base (337)..(337): a, c, t, g, unknown or other
  modified_base (381)..(381): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggccgggggggtccctgagactctcctgtgcagtctctggattcaccttagagttatgatgaccgtggtccgcaggctcgagggaggcgtggagtgggngaccaanataaacaaagacgaagtacaaagaaaacctgtagtgactgtagngacggcatcaccatctaccagacacaaccgacaaagtatacactgttaattgaactaaagtcaaacgacgtccgtaggaggacggcgaagggaaccgacggtccgtagttacttagtgtcgcgtacgagagttagatacggtacgaacttcgtaaacgaaggttaacgcggtaagggttggtacgtacgtagtttcgg

SEQ ID NO: 372283 - DNA, 690 bp, Homo sapiens
  misc_feature: GZ8MTXP02GSE63.15.67.G01.1.454.CMB.2.raw
  modified_base (547)..(547): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcgttgggttttccttgttgtttattttagaaggtgtccagtgtgaggtgcacttggtggagtcggtgggggaggcttggtccgagggcccgggggggttccctggacgacctctcctggtgcagtctcgtggtacttccaccgttaagtaacgtttagttggatcggaccgttcgggtccgccaggcctaccggaggggtaaggggcgtgggaggtggggtacggaccaaaagaataaaacgaaaagaaccggaaagtaaccgaaagaaaaaaccctgtacgtaggtacttcgtaggttacgaccgggccgtaattacccaacctattactaccgagaacgtaaaccaaaccgaaccaaaacgtacttaccgaattgtttaatttacgaactaaaagngaaaccgacgtacctaggaaggacgggtaacggacggtaaccgaccgggttacgttagttaagtttagtcgtgacggacgtagatacgtaatacgtagtactaccgtaaagaagttacggagtaacggttgtagtcggatttg

SEQ ID NO: 372284 - DNA, 542 bp, Homo sapiens
  misc_feature: GZ8MTXP02IVY0D.15.67.G01.1.454.CMB.2.raw
  modified_base (339)..(339): a, c, t, g, unknown or other
  modified_base (373)..(373): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttatggatgacctgggtccgcaggctccaggggaggggctggagtggggtggccaanataaaacaaaggacggaagtcaagaaaaacctangtggactctgtagacgggccattcaccatctcagagacaacgcaaagattcactgtatttgacaaatgaaacagcctagagacggcgaaggacgacggcgtagtaattattgtgcggtcgagatgaataggtacgactcaactaagtacgcgaaggtgtaatgatttcg

SEQ ID NO: 372285 - DNA, 696 bp, Homo sapiens
  misc_feature: GZ8MTXP02GUWZE.15.67.G01.1.454.CMB.2.raw
  modified_base (596)..(596): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcgttggtccgaggcccgggggggtccctgagactctcctgtgcagtctcgtggattcacccttagaagttattggatgaccgtggtccgcaggctccgaggggaacgggcgtggaggtggggtcggaccaaaacgaagtaaaacgaaagaaccggaaagtaccaaagaaaaaccctgtaggtggaccttcgtaggtacgggaccgggccgtaattccgaacctacttaccgtacccgaaggaacgaaccaaaacccggacccaaaaggtaattacctaacttggttattttacgaactaaagtacgaaactacgcctaggaaggacgggacggaacgggaaccgacggggtaccgttagtttaacgtttagtttggnggccggtacggaagagttaaggaacgttaagggtaacgtacttaccgttaaaccgaaggtacggtaacgtaggggttacggttacgtacgtaagtttcgg

SEQ ID NO: 372286 - DNA, 742 bp, Homo sapiens
  misc_feature: GZ8MTXP02HPRCI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttatttagaaggtgtccagtgtgaggtgcacgttgggtggaggtcggtgggggaggtcgttggtccgagggcccgggggggtccctgagctctccgtgtgctagtctcgtggtattcctacccttagtaagttattggatcgaccgttgggtcccgccacggcctccggaggggaaggggcgtaggggtaggtggggtcggaccaaacgaaataaaacgaaaaggaacgggtaaacgtacgaaaacgtaaaaaaccgtagtaggtaggacttcgtacggttaggaccgggccgtaattacccgaaccctagtccctaccgaacgaacgaacccaaaccgacccaaaaggtaactttacccgaacttagtttaatttcgaaactaaataacgaaacgaacgtccgttaggaagggagggacggaaggaacccggtacgggtaccggttagttaaagtttagttacgggtggacccggtacgaagggttatacggggtaaattaaaggtacgtaaccgttaccgtaacgtaaggtacggacgttagggggtaggttaagttcggtaagttttcgg

SEQ ID NO: 372287 - DNA, 705 bp, Homo sapiens
  misc_feature: GZ8MTXP02JYB7O.15.67.G01.1.454.CMB.2.raw
  modified_base (353)..(353): a, c, t, g, unknown or other
  modified_base (397)..(397): a, c, t, g, unknown or other
  modified_base (669)..(669): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagagtgtccagtgtgaggtgcacttggtggagtcgtgggggagcttggtccgagggcccggggggtccctggagactctcctgtgcagtctcgtggtattccaccttagtaagttattggatgaccgtgggtccgccgaggcctccgaggggacgggctgggaggtgggtggacccaanaagtaaaacgaaaggaaccgggaatacgaaaagaaaaacccgtntaggtacgggaactcgtaggacggaaccggggtccgtaaattacccgaccacttacctacccgaaaggaacaaacgaaacccgacccaaaagtaacttcgacttagttatttaggaactaaaagttcgaaaaacgtcggtaacccgtagggaaggaacgggtacgggaaaccgggtaaccggaacccggggtccgtttagggttaattagtttggtacggccggacggtaagagttacggtaaagttaaggtacgtaacgttaccttaaagnggttaacgacgtacggggttagtatgggaactttgg

SEQ ID NO: 372288 - DNA, 593 bp, Homo sapiens
  misc_feature: GZ8MTXP02HG2XS.15.67.G01.1.454.CMB.2.raw
  modified_base (301)..(301): a, c, t, g, unknown or other
  modified_base (384)..(384): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccagggcccggggggtccctgacgactctcctgtgcagtctctggatcacccttagagttatgatgacctggtccncaggctcgagggagggctggaggtgggtgaccaacaaataaacgaaagaacggaagtacgaaagaaaaacctgtagtagactntgtagaccggcatccaccatcaccagacacaacgacaagaattcacttagtacgtttagaactaaaagtacgaaacgacgaccgtaggaaggacgggacggaaacggaccgaccgggtccgttagttacttagttgtgcgcgagatacgagtaagtacgtacttacgtaacgtaaggtacgacgtaggggttagtactgggtactttgg

SEQ ID NO: 372289 - DNA, 736 bp, Homo sapiens
  misc_feature: GZ8MTXP02JOLWS.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgagggcccgggggggtccctggagactctcctgtgcagtctctggattcacccttagagttattggatgacctgggtccgccaggctccgaggggaaggggctgggaggtgggtggaccaaacgaataaaacaaaggacggaaagtacaaagaaaaaccctagtagtacggactcgtggtagaccgggccgtattccaccgtatccgtaccaaggaacgaaccaaaccggacccaaaggtaaactttacccaacctaggtttaatttacgtaaccaaaaagttacgaaaaccgacggtacccgttagaaacgggaacgggaccgggaaagggaaacccgaccggggaccccggttaggttaacgtttaacgtttagggttacgccgggaccgggaagtaagttacggtaaagttaaacggtttaaagggaaccctttaaccgaaaccgttaacggtaacgtaacggtaacgggggttagggtttaaaacgttggtacgttttaacgg

SEQ ID NO: 372290 - DNA, 529 bp, Homo sapiens
  misc_feature: GZ8MTXP02GOUVH.15.67.G01.1.454.CMB.2.raw
  modified_base (346)..(346): a, c, t, g, unknown or other
  modified_base (504)..(504): a, c, t, g, unknown or other
  modified_base (508)..(508): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccggggggggtccctgagactctcctgtgcagtctctggattcacccttagaagttatggatgacctgggtccgccaggctccgaggggaaggggctggagtggggtggccaanataaaacaaagacggaagtcaagaaaaacctatgtggactctgtagacgggccgattcaccatctccagagacaacgcaaagatacactgtattgacaaatgaaacagcctagagaggcgagacacggcgtagtattatgtgcgcgagatgatagtanactnacaagtagcaggtgtatgatg

SEQ ID NO: 372291 - DNA, 535 bp, Homo sapiens
  misc_feature: GZ8MTXP02G2VGD.15.67.G01.1.454.CMB.2.raw
  modified_base (380)..(380): a, c, t, g, unknown or other
  modified_base (407)..(407): a, c, t, g, unknown or other
  modified_base (531)..(531): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggccgggggggtccctgagactctcctgtgcagtctctggattcaccctagaagtattggatgacctgggtccgcaggctccaggggaaggggctggagtggggtggaccaaacataaaacaaagacggaagtcaaagaaaaacctatgnggactctgtgacggccgatcaccatcncagagacaaacgccaaagatcactgtattgacaaaatgaaacagcctagaagaggacgaggacgacggaccgtgtattagtgtgcgcgagatgataagtagacctatacaagtagcaggtgtangatg

SEQ ID NO: 372292 - DNA, 669 bp, Homo sapiens
  misc_feature: GZ8MTXP02IQ88Q.15.67.G01.1.454.CMB.2.raw
  modified_base (314)..(314): a, c, t, g, unknown or other
  modified_base (636)..(636): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcggtgggggaggcgtttggtccgagggcccgggggggtccctggagacctctcctgtgcagtctcgtggattcacccttagaagttattggatgaccgtgggccnccaggctccgaggggaacgggctgggaggtggggtcgaccaaacgagtaaaacgaaagaacggaagtacaagaaaaacctagtagtggtaacttcgtagttacggaccgggtccgaattacccgacctactctaccgaaggtacgaaccgaaaccggaccctaaaggaactttacgaacgttagttaatttcggaactaaaacgttacgaaaaccgaagcccgtaggaaccggagggtaccggaagggaccgaacggtccggttgtaaatttagttcggtgacggtacgaggtagtgtaaagtaggtacgtacgtaccgtanaaggttacgacgtagggttgtagtgacgtttgg

SEQ ID NO: 372293 - DNA, 623 bp, Homo sapiens
  misc_feature: GZ8MTXP02JOANF.15.67.G01.1.454.CMB.2.raw
  modified_base (261)..(261): a, c, t, g, unknown or other
  modified_base (429)..(429): a, c, t, g, unknown or other
  modified_base (551)..(551): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggcccgggggggtccctgagactctcctgtncagtctctggattcacccttagagttattggatgaccgtggtccgcaggctccgaggggaaggggctaggagtggggtgaccaaacataaaacgaaagaacggaatacaaagaaaaaccctgtgtagaactcgtagtacgaccggaccgtattaccaaccacttaccnccgaagaacgaacctaaaccggacccaaataacttcacttagtaactttgacaaagtcgaaaacacgtccaggaagacggacggaggtaaaccgcgggtaccgttggtaaattgtttcgggngacggtcgtagagtagtaataacggtactacgtacaagtaagtacgtacggtaggtagtacgtagtacgttg

SEQ ID NO: 372294 - DNA, 670 bp, Homo sapiens
  misc_feature: GZ8MTXP02G0S8X.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggggtccctggagactctcctgtgcagtctctggacttcacccttagaagttattggatcgacctgggtccgccaggctccgaggggaggggctggaggtgggtggccaaagaataaaacgaaagaccgggaatacgaaagaaaaaccctagtagtaggactcgtaggtaggaccgggccgtaattccaaccctatacctacccgaagacgaacgaaaccgacccaaaggtaacttactaaagttgttaagttttagactaaaagttacgaaacacgtaacccgtaggaaggaacgggacgggaacggtaccgaaccggggtccgttagtacgtttagttggtaggaccggacggtaggattcgggaaattaggtaacgtaccttactaaacgaaggttacacggtaggggttagtagtaggtaacgtttgg

SEQ ID NO: 372295 - DNA, 729 bp, Homo sapiens
  misc_feature: GZ8MTXP02I3VVI.15.67.G01.1.454.CMB.2.raw
  modified_base (691)..(691): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttgggtggagttcggtgggggaggtcgttgggtcccgagggcccgggggggtccctggacgacctctccgtgtgcagtctcgtggattctaacccttagagttatggatgaccgtgggtcccgccaggctccgaggggaacgggctgggagtggggtcggaccaaacgataaaacaaaggacggaaagtcgaaaagaaaaacctgtggtaggacttgtaggtcgaccggggccgtaacttcgaaccctatcctccgaaagaacgaaccaaacccggaccctaaaaaggtaactttacccaaacgtttggtttaaattttacggaaaccctaaaaagtacggaaaaccgtacggttccccgttaaaggggaacgggaacggggacccggggtaaacggtaacccgggaaacccggggttccggtttaagttaaacgttttaagttgggtaccggacggttagagtacgtagaaagttaggttacgaaaccttntaaaccgaagtagtcgtagggtggttaatcggtatttg

SEQ ID NO: 372296 - DNA, 566 bp, Homo sapiens
  misc_feature: GZ8MTXP02FJIBS.15.67.G01.1.454.CMB.2.raw
  modified_base (343)..(343): a, c, t, g, unknown or other
  modified_base (390)..(390): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgcagctccaggggaaggggctggagtgggtggaccaaanaataaaacgaaagacggaagtacaagaaaaacctatagtgactctgngacggccgattcaccatctacagagacaacgccaaagactcactgtatttagcaaaatgaaacagccctagagaggacggagaccgacggaccgtagtattagttgtgcgtcgagagtgaagtacgtaagactcttaacgaagttacgacgtaagggttaggtaacgtagtattgg

SEQ ID NO: 372297 - DNA, 602 bp, Homo sapiens
  misc_feature: GZ8MTXP02GRL8I.15.67.G01.1.454.CMB.2.raw
  modified_base (306)..(306): a, c, t, g, unknown or other
  modified_base (459)..(459): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggcccgggggggtccctgagactctcctgtgcagtctctggattcacccttagaagttatggatgacctgggtccncaggctccgaggggaggggctggagtggggtggccaacataaaacaaagacggaagtacaagaaaaacctatagtgactcgtgtagacggcgatccaccatctaccagacgacaaacgccaaagattcactgtatttagacaaatacgaaacncgccgtagaacggagggaccgacggggaaccgaccggggtaccgttaggttaactttagttaggtggaccgacggaagagtacggtaatagtacgacttacgtaacctaaggtacgacgtagggttagtagtggtaactttgg

SEQ ID NO: 372298 - DNA, 679 bp, Homo sapiens
  misc_feature: GZ8MTXP02JZXTO.15.67.G01.1.454.CMB.2.raw
  modified_base (348)..(348): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgagggccggggggtccctgagactctcctgtgcagtctcgtggattcaccttagagttatggatgaccgtgggtccgcgaggctccgaggggaagggcgtgggaggtgggtcgaccaaanaataaaacgaaagaacggaaagtacaaagaaaaacctagtagtaggtactcgtacggtacggaccgggtccgtaacgttcccaacctactcctaccgaagaaccgaaccgaaaccgacccgaaaagtaaacttcctaacgttagttaactttacggaactaaaagtacgaaacgacgtaccgtaggagggagggaccgggaaggaccgaaccgggtccgtaggttaatttagttacggtcggaccggtcggaaggtagtaggtaaagtaggttaacgtaccgttataaccgtaagtacggacgtacgggttaggtagtacgtagtttacgg

SEQ ID NO: 372299 - DNA, 626 bp, Homo sapiens
  misc_feature: GZ8MTXP02IF6RO.15.67.G01.1.454.CMB.2.raw
  modified_base (306)..(306): a, c, t, g, unknown or other
  modified_base (484)..(484): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggtttttccttgttgttattttagaaggtgtccagtgtgaggtgcacttggtggagtcgtgggggaggcttggtccgaggcccggggggtccctgagactctcctgtgcagtctctggattcacccttagaagttatggatgacctgggtccnccaggcctccgaggggaaggggctagggaggtgggtcggaccaaacagtaaaaacgaaaggaaccggaagtaccaaggaaaaaccctagtggtaggactcgtagtcgaacggggcctaattccacctactctacagaacgacaaccgaccaaagtaacttacacttgtaatttcgaanaaaagtgaaacacgtacctggaagagggaccgaaggaccgacgggacgttaggtaatttagtgtcgacgtcgaaagtatagtaacgtaagttacgacttacgaacgttaagacgtactaaggggtggtatagggtaactttg

SEQ ID NO: 372300 - DNA, 566 bp, Homo sapiens
  misc_feature: GZ8MTXP02IO4AO.15.67.G01.1.454.CMB.2.raw
  modified_base (412)..(412): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggcttgggtccaggccgggggggtccctgagactctcctgtgcagtctctggattcacccttagaagttattggatgacctgggtccgccaggctccaggggaaggggctggagtggggtggccaacataaaacaaagacggaagtacaagaaaaacctatagtggactctgtgacgggcgattcaccatcnccagagacaacgccaaagaattcactgtatttgacaaatagaaacagcctagaggacgggacggaacggacgaccgggccgttagtaatttagttagtcgcggacgagagtacgaatacgtagactatacaagtagcgaggtgtatggattcgg

SEQ ID NO: 372301 - DNA, 575 bp, Homo sapiens
  misc_feature: GZ8MTXP02IZXBV.15.67.G01.1.454.CMB.2.raw
  modified_base (265)..(265): a, c, t, g, unknown or other
  modified_base (349)..(349): a, c, t, g, unknown or other
  modified_base (395)..(395): a, c, t, g, unknown or other
  modified_base (529)..(529): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggctttggtccgaggcccgggggggtccctgagactctcctgtgcngtctctggattcaccttagaagttattggatgtacctgggtcccgccaggctccgaggggaagggctggagtgggtggaccaanataaaacaaagacggaagtacaaagaaaaacctatgtaggaccttntaggtcgaccgggccattccacccatctaccagacgaacaaccgaccaaagattccacttgtatttgacaaatgaaacagcctagagagggcgaacggacgaccggccgtagttattattgtgcggtcgagtangtatacgtacgactacacgaagtacgacgtaggtgtatgtagtttg

SEQ ID NO: 372302 - DNA, 640 bp, Homo sapiens
  misc_feature: GZ8MTXP02FS00D.15.67.G01.1.454.CMB.2.raw
  modified_base (607)..(607): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttgggtggagtcgtgggggaggtcgttgggtccgaggggcccgggggggttccctggagacctctcctgtgcagtctctggtacttcaccttagtaattagttggatgacctggtccgcaggctaccgaggggacgggcgtgggaggtgggcgaccaaagaataaaacgaaaggacggaaagtacaaagaaaaaacctgtgtaggaacttcgtagtacgaccggggcctaacttccaacccagttaccaccgaagaacgaaacaaacccggacaaaagtaaacttcgtaactgttaaacgttttagacaaaatcggtaaaacacgtcaggaagacggacggaaggacgaccggtcgttagttattatggtgtcggaacgagattagaagttagtacgacctacgtaanaaggtacgacggtaggtagtacgtagtacgttg

SEQ ID NO: 372303 - DNA, 731 bp, Homo sapiens
  misc_feature: GZ8MTXP02FVWL7.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggtcgttggtccgagggcccgggggggtccctggacgtacctcctcctggtgctagttctcgtggtacttccaccttaagtaagttagttggatcggaccgtcgggtcccgccgaggccgtaccgaggggaacggggtcgtggggtaggtcggggtcggacccaaaactaaataaaaacgaaaaggaccgggaaagtaccgaaaagtaaaaaacccgtagtaggtacggaccttacgtaggttaacggaaccggtcccgtaatttacccgaacctacgtaccctacgaaacgaaacgaacgaaacccgtacccaaaagtaaacttcgaaccgttagttaaaccgtttagaaccgtaaaaacgttgaaaacctacggtaccgtaagggaggaacgggaccgggaaacggacccgacggggtaccgttaggttaaagtttgttaggtggaccgaacggagtatacggtatacgtacgtactactagaagtagagtggtagtacgtgtagtttg

SEQ ID NO: 372304 - DNA, 640 bp, Homo sapiens
  misc_feature: GZ8MTXP02GIBL7.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggacttcacccttagaagttatggatgaccgtgggtccgccaggctccgaggggaaggggctgggagtggggtggaccaacaagtaaaacaaaggaacggaaagtaccaaagaaaaaccctagtgtggaacttgtacggtagaccggggcctaacgttcaaccctatcctacccgaagaacgaaaccaaaccgacccaaagtaacttcaacttaggttatttgaacaaaagtgaaaccaggcctaggacggaagggacgggaacggaccgaccggggtccgttaggttaatttaagttggtgccgagtaggaatggaaacttaggtacgaacttctaacgaagttacgacgaagggtggtaatgaatttcgg

SEQ ID NO: 372305 - DNA, 608 bp, Homo sapiens
  misc_feature: GZ8MTXP02I8FR4.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttgggtccgagggcccgggggggtccctggagactctcctgtgcagtctctggattcacccttagagttattggatgacctggtccgccaggctccgaggggaagggctggaggtgggtcggaccaaacaataaaacaaaggacggaaagtacaaagaaaaacctagtagtaggactcgtagtagaccgggccgtattccaccgattctaccagaacgaacaaaccgaccaaagaacttacacttgtatttgactaaaatgaaacacgacctaggagagggacgaagggaccgacgggccgtagttacgttagttcggtcgcgtacgagtatagaagtaggtacgtactcgtaacaaggttacgacgtaggtagtatgtatttgg

SEQ ID NO: 372306 - DNA, 647 bp, Homo sapiens
  misc_feature: GZ8MTXP02JDY0L.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggtcgttgggtccgagggcccgggggggttccctggacgtacctctccgtgtgcagtctctggattcacccttagaagttattggatgacctgggtccgccaggctccgaggggagggctggagtcgggtggccaaacataaacaaaggacggaagtacgaaagaaaaaacctgtagtagggaactcgttggtacggaccgggccgtaattccgaacctattccaacccgaagaacgaaccaaaccggaaccaaaggtaaactttccaacttggttaattttacgacctaaaattcgaaacacgtaccctaggaggacgggcggaacggaccgacggggcccgtaggttatttaagttggtcgcggtcgagtagtagaacgtagtacgtactctaaacgaagtagacgtagggtgtagtgtatttcgg

SEQ ID NO: 372307 - DNA, 579 bp, Homo sapiens
  misc_feature: GZ8MTXP02GMSUO.15.67.G01.1.454.CMB.2.raw
  modified_base (300)..(300): a, c, t, g, unknown or other
  modified_base (430)..(430): a, c, t, g, unknown or other
  modified_base (493)..(493): a, c, t, g, unknown or other
tcagtctacgtagccacgaccggtgctcgatttagagtatacatattgggtttgaggtctcagagaggagccttagccctggactccaaggcctttccacttggtgatcagcactaagcacagaggactcaccatggagttggggctgagctgggttttcctgttgttattttagaaggtgtccagtgtgaggtgcacttggtggagtcgtgggggaggcttggtccaggccggggggtcctgagactctcctgtgcagtctctggattcaccttagaagttatggatgacctgggtccncaggctccgagggaaggggctggagtgggtgaccaacaataaacgaaagacggaagtacaagaaaaactctagtgactcgtgtagaacggcattcaccatctacagacgacacgaccaaagaactcactntattgacaaatagaacagaccgtagagaggcgtaagggacacggacgtgtattagttgcgcgngaagagtacggtaattaaacgggtacgtaccgtactaacgaaggttaacggtacggtaaggtacggttagtaggtagttacgttcg

SEQ ID NO: 372308 - DNA, 549 bp, Homo sapiens
  misc_feature: GZ8MTXP02F3PE1.15.67.G01.1.454.CMB.2.raw
  modified_base (441)..(441): a, c, t, g, unknown or other
  modified_base (499)..(499): a, c, t, g, unknown or other
  modified_base (518)..(518): a, c, t, g, unknown or other
  modified_base (530)..(530): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaagtgtccagtgtgaggtgcacttggtggagtcgtgggggaggcttggtccaggccggggggtccctgagactctcctgtgcagtctctggattcacccttagaagttattggatgacctgggtccgccaggctccaggggaaggggctgggagtggggtggccaaacataaaacgaaaagacggaaagtacaaggaaaaacctatagtaggactctgtagacggccgattcaccatctccagagacaacgccaaagaatcactntatttgcaaaatgaaacagacctagagaggcgaggacacggccgtgtattatgtgcgngagatgagtagtacgactntaacgaagtagntaggtgtataggtatttgg

SEQ ID NO: 372309 - DNA, 592 bp, Homo sapiens
  misc_feature: GZ8MTXP02IW6M3.15.67.G01.1.454.CMB.2.raw
  modified_base (305)..(305): a, c, t, g, unknown or other
  modified_base (377)..(377): a, c, t, g, unknown or other
  modified_base (380)..(380): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagaagttatggatgacctgggtccnccgaggctccgaggggaagggctggagtgggtgaccaaacataaaacaaagacgaagtacaagaaaaacctntgngactctgtagacggccattccacatctcagagacacgaccaagaactcactgttattgcaaaatgaaacacgtacctggaagacgggacggacggtaacgaaccgggtccgtaggtaatttagttagtcgccggtacgagagtacggaattaaggtacgaacttctaaacgtaagtacggacgtaggggttaggtacgtaggtaagtttcgg

SEQ ID NO: 372310 - DNA, 670 bp, Homo sapiens
  misc_feature: GZ8MTXP02I9TGT.15.67.G01.1.454.CMB.2.raw
  modified_base (318)..(318): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcggtgggggaggcgttcggtccgacgggcccggggggtccctggagactctcctgtgcagtctcgtggtacttccaccgttaagagttattggatcgaccgtgggcccncgaggctacgaggggacggcgtgggagtggggcgaccaaacaataaacgaaaggacgaataacgaaagaaaactagtgtagactcgtagtacgaccggcctaacgttccaacctactcctaccaagaaaccgaacaaaccgacaaaagtacttacccaagttacgtttaatttacggaaactaaaagtacgtaaacgacgtacccgtaggaacgggacggaccgggaacggaaccgaccgggtcgttaagttacgttaagtttggacggcgaacggtagaagttagaaacgttaaggtacgtaacttccgtaagaaggttacgacgttaagggtgtaagttcggaagtttcg

SEQ ID NO: 372311 - DNA, 939 bp, Homo sapiens
  misc_feature: GZ8MTXP02HIC8R.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaggtgtccagtgtggaggtgctacttgggtgggaggtcggtggggggtaggcgtttcgggtccgacggggtccccgggggggttccctggaacgtaccttccttccgtggtgcctaggttccttcgttaggactttcctaacccgttaaggaaagtttattgggatcggtacccgtggggtccccgccgaggcctacccggaaggggggaaggggtccgttaggggagggtttcgggggtacgggaccctaaaaacgtaaacgtaaaaaaaccggaaaaggggtaaaccgggtaaaacggttaaaccgaaaaaaggtaaaaaaaaaaccccgtttagggttaggggttaaccggggtaaacctttccggttaaggggtttaaaccggggaacccgggggtacccgttaaatttaacccccgaaccctaacggttacccctacgaaaacgggaaccggtaaaccaaacccggaaacccgtaaaaggttaaacttacccgtaactttaggtttaacgtttaacgaaacctaaaagttacgaaaccgtaaacggtacccgtagggaaacgggtaacggggaccgggaaacgggaaccggttaccggggacgggtttaacggttaacgttttaacggttgggtacggtccgggtaacgggagttaaggtacggtaaagttaaacggggtaacttaaaacccgtgttaaaaccggaagtttaaacgggacgtacgggggttaggtttaacgacggtttaacgtttcggg

SEQ ID NO: 372312 - DNA, 758 bp, Homo sapiens
  misc_feature: GZ8MTXP02JP7SA.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcgttgggtccgagggcccgggggggtccctggagaccttctcctggtgctagtctcgtggtacttccacccttagaagttagttggatcggaccgtcgggtcccgccgaggcctccggaggggaaggggcgtaggggaggtggggtacggacccaaaacgaaagtaaaaacgaaaacggaacggaaagtaacgaaagtaaaaaacccttagtaggtacggtaacttcgtacggttacggaccgggccgtaacgttacccaaccgtaacttcccgtaccgaaaggaacgaaacccgaaacccgaacccgaaaagtaacttacctacgttacgttaactttacggaaacctaaaagtacgaaaaccgtaacggtacccgtaaggaaggaacgggaccgggaacggaaccgaccgggtaccggttagttaacgttagttaggtcgacggacggtagtaagtacggtaaagttaggtaacgtaaccgttacgtaaacgtaaggtaagtacggtaggtaggttagttacggtagttttacgg

SEQ ID NO: 372313 - DNA, 648 bp, Homo sapiens
  misc_feature: GZ8MTXP02GFSRB.15.67.G01.1.454.CMB.2.raw
  modified_base (393)..(393): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccgagggccggggggtccctgagactctcctgtgcagtctctggattcacccttagtaagttattggatcgaccgtcgggtccgccgaggcctccgaggggaagggcgtggaggtgggtcggaccaaacaataaaacgaaaggaacggaagtacaaagaaaaaacctntaggtaggacttcgtagtacggaccgggtcccgtaagttaccaacccgtactctacccgagaacgaaccaaaccgaccaaagaacttaccaacttagttaattacgaacaaaagtagaaaacgagaccgtaggaagacgggacggaaggaaccgacggtaccggttagttatttagttcgtcgaccggacgagtatacggtaataaggtacgtacctacgtaacgaagtacgacgtaggtagttagtgtatttgg

SEQ ID NO: 372314 - DNA, 646 bp, Homo sapiens
  misc_feature: GZ8MTXP02JXVDN.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggagtcgtgggggaggcgttggtccgaggcccgggggggtccctggacgacctctcctgtgcagtctctggacttccacccttagaagttattggatcgaccgtgggtcccgcgacggctccggaggggaagggcgtggaggtgggtcggacccaaagaagtaaaacgaaaagaacggaaagtacaaagaaaaaccgtagtgtaggactcgtgtacggacggccgtattccgacctgtcctaccgagacgaacaaaccgaccaaagtaacttacgacttagttaatttacgactaaaacgtagaaaacgacgaccgtagggagacgggaccggaaacggacgtacccgggtacgttagttatttagtgtcgcgtacgaggtagtagtaagtaacgtagtacctaacgtagaagtagacgtagggtagtgtaagtgtttacgg

SEQ ID NO: 372315 - DNA, 665 bp, Homo sapiens
  misc_feature: GZ8MTXP02IH9ND.15.67.G01.1.454.CMB.2.raw
  modified_base (350)..(350): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgctacttgggtggagtcgtgggggaggcttggtccgaggcccggggggtccctgagactctctgtgcagtctcgtggtattcaacccttagaagtttattggatgacctgggtccgccaggctccgaggggaagggctggaggtggtgaccaaanaataaaacaaagaacggaagtacaagaaaaacctatgtagctgtgagacgcattccaccatctacagacaacaacgacaagtaattacacgttagttatttagaactaaaatacgaaaactacgaccgtagaaggacggacggaaggaaccgacgggtaccgttagttaagtttaagttttgggacgtaccggtaccggtaaagtaaacgttacggtaaattaaaccgggtaaggtaaaacccctttcgtaaaaccgtaaagggttacgtaaacgtaaagggggttagttaaggtaccgtttaagtttaaccggg

SEQ ID NO: 372316 - DNA, 623 bp, Homo sapiens
  misc_feature: GZ8MTXP02FFQYY.15.67.G01.1.454.CMB.2.raw
  modified_base (268)..(268): a, c, t, g, unknown or other
  modified_base (395)..(395): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggagtcgtgggggaggcttggtccgagggccgggggggtccctgagactctcctgtgcagtctnggattcacccttagagttattggatgacctggtccgcagctccgagggagggctggagtgggtcgaccaaacaataaaacgaaaagtaccggaaatacgaaagaaaaaacccctgtgaggactacgnggtaggaaccgccgaattccaccatcgtaccaagacaaacaccgaccaaagtatacactgtaatttagacaaaagtcgaaaacgcgaccgtggaacgagggaccgggaaggaccgaccggaccggttagttaacgttaagttcgtggacgacggaagagttacgaaagttaggtaacgtacccgtattaaccgaaggttaacgacggaagggttgtaagtgacgtttg

SEQ ID NO: 372317 - DNA, 793 bp, Homo sapiens
  misc_feature: GZ8MTXP02HHAQU.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggaggttgggctgagcgttgggttttccttgttgttatttagaaggtgtccagtgtgaggtgctacgttgggtggaggtcggtgggggaggtcgttgggtccgagggcccgggggggtccctggacgactctcctgtgcagtctctggattcacccttagaagttattggatgaccgtgggtccgccgaggctccgaggggaaggggctgggaggtggggtggaccaaacaagtaaaacaaaggaaacggaagtacgaaagaaaaacctataggtaggaaccttcgtaggttaggaccggggtccgtaagtttaccaaccctatccctacccgaaaggaacgaaaccaaacccggaacccaaaaggtaacttacctaacgttacgttaattttaggaacctaaaataacgaaacgaacgtacccgttaggaacgggacgggacgggaacggggaaacccgaccggggtacccggtttaggtttaaacgttttaaggtttgggttacggtacccggacgggtaaagtaggtaacggtaaaacggttaaagggtaaacgggttaacctttaacccgttaaaccggttaaacgggttaacggggtaacggttaaacgggggtttaagggttaacgtttaccggggttaaagtttttcgggg

SEQ ID NO: 372318 - DNA, 555 bp, Homo sapiens
  misc_feature: GZ8MTXP02JLX3E.15.67.G01.1.454.CMB.2.raw
  modified_base (306)..(306): a, c, t, g, unknown or other
  modified_base (385)..(385): a, c, t, g, unknown or other
  modified_base (462)..(462): a, c, t, g, unknown or other
  modified_base (470)..(470): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggccgggggggtccctggagactctcctgtgcagtctctggattcacccttagagttatggatgacctgggtccncaggctccaggggagggctggagtgggtgtcaacataaaacaaagacggaagtacaagaaaaacctatgtaggactcgngtagacgggccgattccgaaccatcctaccagacgaccaacgacccaaagaacttcactgtatttgacaatgaaacngcctgagngacgagacgacggcgtagtatatgtgcgacgagagtgtaagtagtacgtactctaacgaagtagcgtaggtagtacgtgaatttg

SEQ ID NO: 372319 - DNA, 579 bp, Homo sapiens
  misc_feature: GZ8MTXP02FUUCK.15.67.G01.1.454.CMB.2.raw
  modified_base (227)..(227): a, c, t, g, unknown or other
  modified_base (236)..(236): a, c, t, g, unknown or other
  modified_base (283)..(283): a, c, t, g, unknown or other
  modified_base (306)..(306): a, c, t, g, unknown or other
tcagtctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcacctatcacttgccgganagtcagganattagaactgacttaggttgtatcagacaagaaacgtaccgggaacncccctaagctcctagatctggtnctagcattcctaactttaacgaaaggtcgggtacccccagtacgtaaaggtcgagccggactgggtgaactcgtcggacaagtagtactttccaactcctaccacaatcaagcctaacgcccgtgacctacgtaccgtagtaaacgtactttacctacttaaacttagttactgtaccaactaaattactaaacgtaacttccgtaggaccgtcggaacgaggggaacacgggtaacgaaactacgaaacgtagtcgacggctcgacacctag

SEQ ID NO: 372320 - DNA, 560 bp, Homo sapiens
  misc_feature: GZ8MTXP02FRFU7.15.67.G01.1.454.CMB.2.raw
  modified_base (347)..(347): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattcacccttagaagttattggatgacctgggtccgccaggctccgaggggaaggggctggagtgggtggaccaaanataaaacaaagacggaagtacaagaaaaacctatgaggactctgtgacggccgattcaccatctccagagacaacgaccaaagaattcactgtatttgactaaaatgaaacagacctagagagggacggaaggaccgacggccgtagttagttatgtgcggacgagagtgtaatagtacgactactacgaagtagacgtaggtgtaatgattg

SEQ ID NO: 372321 - DNA, 548 bp, Homo sapiens
  misc_feature: GZ8MTXP02GA3VG.15.67.G01.1.454.CMB.2.raw
  modified_base (349)..(349): a, c, t, g, unknown or other
  modified_base (377)..(377): a, c, t, g, unknown or other
  modified_base (455)..(455): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggcgttgggtccgagggcccgggggggtccctggagactctcctgtgcagtctctggattcacccttagagttattggatgacctgggtccgccaggcctccgaggggagggctggagtgggtgccaanataaacaaagacgaatcaagaaaacctntgtggactctgtcgacggccgattcaccatctccagagacaacgccaaagaatcactgttatttagacaaatgaaacngcctagagaggcgaggacacggccgtagtacttagtgtgcggtcgagatgatagtagactcaagaagtacgacgtaggtaggtatgtatttgg

SEQ ID NO: 372322 - DNA, 654 bp, Homo sapiens
  misc_feature: GZ8MTXP02FKGJ0.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagtaagttattggatgacctgggtcccgccaggctccgaggggaaggggcgtgggaggtggggtggacccaaacaagtaaaacgaaaagaacgggaaagtacaaagaaaaaacctagtagtaggacttcgtggtagaccgggccgaattccaacccattcctaccaaagacgaaccaaaccgacccaaaagtaaattacctaacgtgttaatttagactaaaatcgtaaaacagacctagaagggacgggacggaacggaaccgaccgggaccggttagttaactttagtttggtagccggtacggagagtagaaagttacgtaacgtacctacgtacaaggtacggacgtagggttaggtaacgtgaagtttgg

SEQ ID NO: 372323 - DNA, 554 bp, Homo sapiens
  misc_feature: GZ8MTXP02F6SZN.15.67.G01.1.454.CMB.2.raw
  modified_base (350)..(350): a, c, t, g, unknown or other
  modified_base (383)..(383): a, c, t, g, unknown or other
  modified_base (412)..(412): a, c, t, g, unknown or other
  modified_base (421)..(421): a, c, t, g, unknown or other
  modified_base (547)..(547): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccgagggcccgggggggtccctggacgactctcctgtgcagtctctggattcacccttagaagttattggatgaccgtggtccgccaggctccgaggggaagggctgggagtgggtggccaanataaaacgaaagacgaagtacaagaaaaacctntgtaggactctgtagaccggcgatccacntactcaganacaacgccaaagattcactgtatttgacaaatgaacagcctaggagaggtacgaggaccgacggtccgtagtattagtgtgcgacgagatgagtagtacgactacagaacgtagacgtaggtgtangtacttg

SEQ ID NO: 372324 - DNA, 625 bp, Homo sapiens
  misc_feature: GZ8MTXP02GWV1D.15.67.G01.1.454.CMB.2.raw
  modified_base (385)..(385): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggtcgttggtccgagggcccgggggggtccctggagacctctcctgtgcagtctctggattcacccttagaagttattggatgacctggtccgccgaggctccgaggggaggggctggaggtggggtagccaacaataaacaaaggaacgaagtacaagaaaaacctntgtaggacttcgtagtggaccggggccaagttccacctatcctaccgagaagacaaacgacccaaagtaattcacttgttaatttcgactaaaactagaaacacgtacctaggacgagggacggaacggaccgacgggtccgtgttaacttagttgttaggcgtacgaaggtataggtaagttaagtacgtaacgtactaacgtaaggacgtacgtagggttggtaagttgaagtttcgg

SEQ ID NO: 372325 - DNA, 706 bp, Homo sapiens
  misc_feature: GZ8MTXP02HHCYS.15.67.G01.1.454.CMB.2.raw
  modified_base (304)..(304): a, c, t, g, unknown or other
  modified_base (347)..(347): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttcttgttgttattttagaaggtgtcagtgtgaggtgcattggtggagtcgtgggggaggtcttggtccgaggcccggggggtcctgagactcgtcctgtgcagtctctggattcaccgtagaagttatcggatgaccgtggtccncaggcaccgaggggaacgggctggagtggggtcggaccaaaanaaagtaaaacgaaaggaacggaaagtaacaaaagaaaaacctgtaggtacgacttcgagtaacggaccggaccgtaacttaccaacctacgttaccaccgaaagaaacgaaaccgaaaccgaaccaaaacgttaacttacctaaacgttagtttaagttacgaaactaaaacgtaacgaaacgaaacgacgtaggaagggaacgggacgggaacggaaccggaaccggtaaccggttacgtttaacgtttaagtttacggttacggtacggacggtagaagtagtaaagttaacgttaacgtaacgtaacgtaacgtaacggtaacggtacggtacggtaggtacggtacgtaagtacg

SEQ ID NO: 372326 - DNA, 555 bp, Homo sapiens
  misc_feature: GZ8MTXP02JWU1S.15.67.G01.1.454.CMB.2.raw
  modified_base (376)..(376): a, c, t, g, unknown or other
  modified_base (384)..(384): a, c, t, g, unknown or other
  modified_base (449)..(449): a, c, t, g, unknown or other
  modified_base (461)..(461): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgcagctccgaggggaaggggctggagtggggtggaccaacataaacaaagacggaagtacaagaaaaacctntgtgactntgtgacggcattcacatctaccagacacaaacgcctaaagattcactgtattgacaaatgaaacngcctgagacggngagtacacggtcctagtattagtgtgacggcgagagtagtagtacgtacgtacgtactacgtaacgtacgtacgtacggtaggtagtagtagtg

SEQ ID NO: 372327 - DNA, 553 bp, Homo sapiens
  misc_feature: GZ8MTXP02JJ1ZW.15.67.G01.1.454.CMB.2.raw
  modified_base (266)..(266): a, c, t, g, unknown or other
  modified_base (381)..(381): a, c, t, g, unknown or other
  modified_base (385)..(385): a, c, t, g, unknown or other
  modified_base (409)..(409): a, c, t, g, unknown or other
  modified_base (412)..(412): a, c, t, g, unknown or other
  modified_base (449)..(449): a, c, t, g, unknown or other
  modified_base (454)..(454): a, c, t, g, unknown or other
  modified_base (461)..(461): a, c, t, g, unknown or other
  modified_base (518)..(518): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtcccaggccggggggtccctgagactctcctgtgcagtctntggattcacccttagagttattggatgaccgtgggtccgccaggctaccgaggggaagggctgggagtggggtcgccaaacaataaacaaagaacggaagtacaagaaaaacctntagngactcgtgtagacggcatcaaccntcnccagagacaacgaccaagattcactgtattgacaatnaaacngcctagngaggcgaagacgacggcgtagtacttagtgtgcgacgagattacgatagtacgactntaacgtaagaacgcgtaggtagtagtcgatttcgg

SEQ ID NO: 372328 - DNA, 791 bp, Homo sapiens
  misc_feature: GZ8MTXP02HIGH7.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggaggtcgtgggggagtcgttcggtccgacgggcccgggggggtccctggacgtacctccgtccgtggtgctagtctctggacttccacccgttagaagttatggatcgaccgtgggtccgcgaggctccgaggggagggctgggaggtggggtacggaccaaacgaactaaaacgaaaggaacggtaaacgtacaaaaggtaaaaaaccctgtacggtacggaacttcgtacggttacggaccgggtccgtaagtttacccaacctaacgtccgtaccgaaagggacgaaacccgaaaccgaacccgaaaggtaaactttaccgtaaccgttacgttaagtttacaacgtaaaacgtcgaaaaccgacggtacccgttaagggaacggacggggaaccgggaaaccggggaacccgtaaaccgggggttcccggttaaggtttaaaacgtttacgggtttgggttaccggggaaccgggttaaccgggaaaggttacggtaaacggttaagttaaaacgggtacgtaaaccgttacgtaaacgtaaggttacgacgtacggggttagtacgtacgtacgttttcgg

SEQ ID NO: 372329 - DNA, 618 bp, Homo sapiens
  misc_feature: GZ8MTXP02J12LE.15.67.G01.1.454.CMB.2.raw
  modified_base (306)..(306): a, c, t, g, unknown or other
  modified_base (338)..(338): a, c, t, g, unknown or other
  modified_base (395)..(395): a, c, t, g, unknown or other
  modified_base (398)..(398): a, c, t, g, unknown or other
  modified_base (459)..(459): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgctacgttggtggagtcgtgggggaggcttggtccgaggcccgggggggtccctgagactctcctgtgcagtctctggattccaccttagagttatggatgacctggtccncaggctccgaggggaggctggagtggtgcaanataagaagacgaatcaaagaaaacctagtgtaggactgtaggtgacggcattcactntcncagaagacctaacgaccaaagtaccttacacgttagtatttacgactaaagtagaaaccgngtacccgagggacgagggccggtaaaggaccgtaccggggtactagtttacgtttagttggaccggcttaaccgggagtacgtggaaacgttaaggtacgaacctttaccgaagaaggttacgacgtagggggtttataacgtggttaccgtttaacgg

SEQ ID NO: 372330 - DNA, 664 bp, Homo sapiens
  misc_feature: GZ8MTXP02JQ8FY.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggaggggaggtcgttgggtccgagggcccgggggggttccctggacgacctcctcctgtgcagtctcgtggattcacccttagaagttatggatgaccgtgggtccgccgaggcctccgaggggtaacggggcgtgggaggtggggtacggacccgaaacaagtaaaaacgaaaaggacggtaaagtacgaaaacgaaaaactagtagtaggactcgttagtggaaaccggcgtaacctttacaacccgatacctacccgagaacgaaaccgaaccgaccgaaagtaacttactacgttcgttaaagtttgaaccaaattacggaaacacggacctaggaggacggggacgaacggaccgacggaccgtaggttattagttcgtacggcgtacgagtagtgaagttacgacgtaacctcgaaacgtagtacgcgtagggttcgtagtagtag

SEQ ID NO: 372331 - DNA, 576 bp, Homo sapiens
  misc_feature: GZ8MTXP02JC00B.15.67.G01.1.454.CMB.2.raw
  modified_base (383)..(383): a, c, t, g, unknown or other
  modified_base (396)..(396): a, c, t, g, unknown or other
  modified_base (443)..(443): a, c, t, g, unknown or other
  modified_base (508)..(508): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttgggtccgagggcccgggggggtccctggagactctcctgtgcagtctcgtggattcacccttagaagttattggatgacctgggtccgccaggctccgaggggagggctggagtgggtgccaacagtaaaacaaagacggaagtacgaagaaaacctntgtggactcgtgngacggccattccaccatcctacagacgacaaacgcccaaagaacttnacttgtatttgacaaatgaaacagacctaggagaggacggaggacgacggacgtgtaattattgngtcgacgagagtagaattaggtacgactcgtaacgtaagtacgagtagggtagtaagtcgtaagtttg

SEQ ID NO: 372332 - DNA, 572 bp, Homo sapiens
  misc_feature: GZ8MTXP02FF51Z.15.67.G01.1.454.CMB.2.raw
  modified_base (333)..(333): a, c, t, g, unknown or other
  modified_base (382)..(382): a, c, t, g, unknown or other
  modified_base (426)..(426): a, c, t, g, unknown or other
  modified_base (565)..(565): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggctttcggtccgacgggccgggggggtccctggagactctcctgtgcagtctctggattcacccttagaagttattggatgacctggtcccgcaggctcaggggagggctggngtggtggccaacaataaacaaaagacggaagtcaagaaaaacctgtagnggactcgtgtagaaccggccgaattcaacccatctaccaagaanaccaaacgcccaaaagaattacactgttatttcgctaaaatcgaaacagcctagagaggcgaaggaccgacggcgtgtattagtgtgcgcgagatcgattacggatactactacgaagtacgacgtagggtagttaagngtagtcg

SEQ ID NO: 372333 - DNA, 681 bp, Homo sapiens
  misc_feature: GZ8MTXP02FLA02.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggcttggtccgacgggccggggggttccctgagactctcctgtgctagtctctggattcaccttagagttattggatgaccgtggtccgcaggctccgaggggagggctggaggtgggtcgaccaaacgaataaaaccgaaaaggaccggaaagtaccgaaaagtaaaaacctagtaggtaggtaaccttcgtacggttacgggaacccggggtaccgtaactttaccaaccctatccctaccaaacggaacgaaacccaaaccgtaacccgaaaagtaaacttacctacgttagttaatttacgactaaaatcgaaaccagaccgtaggaagacgggacggaaggaaccgaccgggtaccgttagttagttaagttggacgcggacggaatagtagtaagttaagtaacgtaaccgtctaacgaagtacggtacgtaggggttagtagtcgaagttttgg

SEQ ID NO: 372334 - DNA, 700 bp, Homo sapiens
  misc_feature: GZ8MTXP02HFZ1W.15.67.G01.1.454.CMB.2.raw
  modified_base (358)..(358): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttgggtggagtcggtgggggaggcgttgggtccgagggcccgggggggtccctggacgactctcctgtgcagtctcgtggattcacccttagaagttatggatgaccgtgggtcccgccaggctccgaggggaacgggctgggaggtgggtcgaccaanataaaacgaaagacggaagtacaaagaaaaaccctagtagtaggactcgtaggtacgaccgggccgtaattaccaaccattccgtaccgagaacgaaccaaaccgacccaaagaacttacacttagtaatttagaacaaaatacggaaacacgtaccgtaggaaggacgggacggaacgggaccgtaaccggggtccgttaggttaaacgtttagtttacggtggacccggtacggtaaaggtagttacggaaagttaaacggttaacggtaaccttacgtaaccggtaaggtttaacggacggttacggggtttaggttacgttacggtaacgttttcggg

SEQ ID NO: 372335 - DNA, 642 bp, Homo sapiens
  misc_feature: GZ8MTXP02H7RNT.15.67.G01.1.454.CMB.2.raw
  modified_base (495)..(495): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttgggtggagtcgtgggggaggcttggtccaggccggggggtccctgagctctcctgtgcagtctctggacttcacctagattatgatcgacgtggtccgcaggctccgaggggacggctggagtgggtacggaccaagaataaaacgaaaggacggaagtaccgaaagaaaaaccctagtggtaggacctcgtaggtacgaccggccgtacttacacccgtatcccgtaccagaacgacaaaccgccgaaagtacttaccgactttgttaacttcgaacgtaaattcggaaaaccncggtaccgtaggaacgggacggacccggaagggacccgtaacgggtccgttaggttaagttatgggtagcccggtacgtagtacggtgaaccgttagacgtactcgtaaacgtggtaacgacggtaggttaggtatagtacgtttcg

SEQ ID NO: 372336 - DNA, 775 bp, Homo sapiens
  misc_feature: GZ8MTXP02GQVGM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcggtgggggaggtcgttggtccgacgggcccggggggtccctgacgtactctcctgtgctagtctcgtggattccaccgttagtaagttattggatcgaccgtgggtcccgccgaggcctaccggaggggaacggggtcgtggggaggtggggtacggaccaaaacgtaaataaaacgaaacggaacggaaataccgaaaagaaaaaacccgttgtacggtagtaccttcgtaggtacggaccgggtccgtaacttacccaacctataccgtacccgaaaggaaaccaaacgaaaacccggacccaaaaggttaaaccttaccctaaacgtttacgttaagtttacgaaacctaaaagttacggaaaacacggtacccgtaagggaacggaacggggacgggtaacggaacccgtacggggtaccgtttagttaaacgtttggttaacggtcgtaaccggacgggtaaatacgggttaacgtaaacggttagggtaacctaacgtttaaccgaacggtaacggtaacgtaggtaggtttaaccgggtaactggtaaacgttttggg

SEQ ID NO: 372337 - DNA, 734 bp, Homo sapiens
  misc_feature: GZ8MTXP02JK45Z.15.67.G01.1.454.CMB.2.raw
  modified_base (557)..(557): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgcacgttggtgggagtcggtgggggaggtcgttgggtccgacggggcccgggggggtccctggacgactcctcctgtgcagtctctggattccaccttagtaagttatggatgaccgtggtcccgcaggcctacgaggggaggggcgtagggaggtggggtcggaccaaagaaactaaaacgaaaggaaacggaatacgaaagtaaaaacctagtcggtaggtacctgtagtacgggaccggggtcctattacccgaaccctattccctaccgaaggaaccgaaaccgaaacccggacccaaaaggtaaccttacgtaactttacgttaagttttacgaaactaaaagtacgtaaaaccncggaacccgttaggaacggggaacgggaccgggaaacgggaaccgtaaccgggggtaccggtttaaggttaaactttggttacggtacggacgtacgggtaaagtagtaacggtaaagttacggtaagtacctaacgtacgaacggtagacggtaaggtggttacgtgagtttacgg

SEQ ID NO: 372338 - DNA, 518 bp, Homo sapiens
  misc_feature: GZ8MTXP02FLUIW.15.67.G01.1.454.CMB.2.raw
  modified_base (189)..(189): a, c, t, g, unknown or other
  modified_base (336)..(336): a, c, t, g, unknown or other
  modified_base (365)..(365): a, c, t, g, unknown or other
  modified_base (438)..(438): a, c, t, g, unknown or other
  modified_base (441)..(441): a, c, t, g, unknown or other
  modified_base (445)..(445): a, c, t, g, unknown or other
  modified_base (468)..(468): a, c, t, g, unknown or other
tcagtctacgtagccacgaccggtgctcgattagagtatacatattggggtttgaggtctcagagaggagccttagccctggactccaaggcctttccacttggtgatcagcactgagcacagaggactcaccatggagttgggctgagctgggttttccttgtgttatttttagaagtgtccagtgtnaggtgcacttgtgagtctgggggaggcttggtccagccgggggggtccctgagactctcctgtgcagtctctggatcacccttagagttatggatgacctggggtccgccaggctccagggaagggggctgggagtgggtggccaanataaacaaagacgagtcagaaaaaccctntgtgactctgtgacgccgattcaccatcgtccagagacaaacgccaagaatcactgtattgcaaaatgaaacngcngagngcgagacacggtctgtatagtgngcgacgagatgatagacgtactctaacgaagtagcgtaggtgtatgactg

SEQ ID NO: 372339 - DNA, 590 bp, Homo sapiens
  misc_feature: GZ8MTXP02H9KR9.15.67.G01.1.454.CMB.2.raw
  modified_base (328)..(328): a, c, t, g, unknown or other
  modified_base (345)..(345): a, c, t, g, unknown or other
  modified_base (378)..(378): a, c, t, g, unknown or other
  modified_base (390)..(390): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggagcttggtccaggccgggggggtcctgagactctcctgtgcagtctcgtggattccacccttagaagttattggatgaccgtgggtccgccgaggctccgaggggagggcgnggagtggggtgaccaanataaaacaaagacggaaagtacaagaaaacctntagtgacttcgngtagacggccgattccgacatcgtaccagacgacaacgtacccaaagtaactactaacttggtttaactttggaactaaatacgaaacgacgtaccgtagaggaggacggaggacgacggccgtgtattagtgtgcgacggatgtagacgtagtacgtactcgtaaacgaagttagacgtaggtaggtatagtacgttag

SEQ ID NO: 372340 - DNA, 714 bp, Homo sapiens
  misc_feature: GZ8MTXP02JOWDF.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttatttagaaggtgtccagtgtgaggtgcacgttgggtgggagtcggtggggggaggtcgttgggtccgaggggcccggggggggttccctggacgtaccttcctccgtggtgctagttctcgtggattccacccttagaagttattggatgacctgggtcccgccgaggcctccgaggggaaggggcgtggaggtggggtcggaccaacaataaaacgaaaggtaacgggaaagtacaaagaaaaacctagtagtaggaacttcgtaggttacgaccggggaccgtaattaccgacctatcctaccaaggaacgaaccaaaccgaccgaaagtaaacttactacgttagttatttacgactaaaatacgaaactagcccgtaggacggacgggacggaacgggacgaccgggtaccgttaggttaagtttagttacgtggaccggacggagtagtacggtaaagttaggttaacgtaacttacccgttaaacgtaaggtaaccggtacggtacggggttaggttaacgttaggtaacgttttcgg

SEQ ID NO: 372341 - DNA, 796 bp, Homo sapiens
  misc_feature: GZ8MTXP02HOSUW.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttattttagaaggtgtccagtgtgaggtgcacttggtggagtcgtgggggagcttggtccgaggcccggggggtccctggagactctcctgtgcagtctcgtggacttccacccttagaagttattggatgaccgtgggtcccgccgaggcctccgaaggggaagggtcgtgggaggtggggtcggaccaaacaagtaaaaacgaaaggaaccggtaagtacgaaagtaaaaaccctagtagtacggacttcgtaggtacggaccgggtccgtaattacccgaaccctacttcccgtaaccgaacgaaaccgtaaacccgaaacccgtaacccgtaaaacggtaactttaccaaacgtttcgttaaagttttcggaaacctaaaagttacgaaaaccgtagacccgttaaggaacggaacgggacccgggaaacggaacccgtaacccggggtacccggtttaagttaagtttaacggtttacgggtcgtaccggtaaccgggtaagtaaccggttaggtaaaccgttaaacgggttaacggtaaccccgtttacgaaaaccgtaagggttaacggtacccggtaacgggggtttaacggttaacgttacggttaagttttaccgggg

SEQ ID NO: 372342 - DNA, 771 bp, Homo sapiens
  misc_feature: GZ8MTXP02GJMD1.15.67.G01.1.454.CMB.2.raw
  modified_base (265)..(265): a, c, t, g, unknown or other
  modified_base (314)..(314): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgctacgttggtggattcggtgggggagcgttggtccgagggcccggggggtcctgacgctctcctgtgcngtctctggacttctacccttagaagttatggatcgaccgtggtccgcgngctccgaggggaggctggaggtgggtcgaccaaacgaataaaacgaaaggacggaagtaccgaaaagtaaaaacctagtaggtcgacttcgtaggacggaccggccgtacttaccaaccctataccgtaccaaaggaacgaaaccgaaacccggacctaaaacgtaacgttaaccctacgttaggtttactttacggaaactaaaagttaccgaaaacgtacggtacccgttagggaacggggacgggaaccccggggaaagggaaccccggtaacccgggggtacccggttttaaggtttaaacgttttacggttttagggcccgggaaccggggttacgggaaaaggttaggttaacggtaaaggttaaacgggtaacttaaccccgtagttaaaaccgttaagggaaccgttaggggtacggggtttaggtagttaccggttaagtttttacgg

SEQ ID NO: 372343 - DNA, 588 bp, Homo sapiens
  misc_feature: GZ8MTXP02FNQKX.15.67.G01.1.454.CMB.2.raw
  modified_base (352)..(352): a, c, t, g, unknown or other
  modified_base (578)..(578): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggagtcgtgggggaggcttgggtccgagggcccgggggggtccctggacgactctcctgtgcagtctctggattcacccttagagttattggatgacctggtccgccaggctccgaggggaaggggctgggagtggggtggacccaaanaataaaacaaaagacggaaagtacaaagaaaaacctatgtaggactctggtagaccgggccgaattccaccatctcagaagacaaacgccaaagacttacactgttattagacaaaatcgaaaacacgacctaggaagagggaccggaagggaccacgggtccgtagttatttatggtcgcgtacgagatagatagtagactactacgaagtagcgagggtagtanggtatttcgg

SEQ ID NO: 372344 - DNA, 820 bp, Homo sapiens
  misc_feature: GZ8MTXP02F6WLB.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgctacgttgggtgggagttcggtgggggaggtcgtttgggtcccgaggggcccggggggggtccctggacggtacttctccgttggtgctagttctcgtggtatttccacccgtttaagtaagtttattgggattcggacccgttcggggtccccgaccgaggtcctacccggaagggggaaacgggggtcgtaggggtaagggttgggggtacggacccaaaaacgaacttaaaaaacccggaaaagggaaaccgggaaaagtttaccgaaaaaggtaaaaaaaccccgttagtaggttacgggaaccttccggtaggttaacgggaaccccgggtcccgtaaatttaccccgaaaccctacttcccgtacccgaaagaaacgaaaccgaaacccaccgaaaacgtaacttaccaccgttaggtttaacttttacggaactaaaaacgttggaaaaccacggtaacccttagggaaacggggacgggaccgggaacgggaaccggtaccgggtcccgttaaggtttattagttggtacggacggcgagagttaggaaagttaccggattaaccgtccgttaaacgtaaggtagaacggtaggttaggtagtagtacgtttag

SEQ ID NO: 372345 - DNA, 583 bp, Homo sapiens
  misc_feature: GZ8MTXP02IK1PO.15.67.G01.1.454.CMB.2.raw
  modified_base (472)..(472): a, c, t, g, unknown or other
  modified_base (488)..(488): a, c, t, g, unknown or other
  modified_base (498)..(498): a, c, t, g, unknown or other
  modified_base (504)..(504): a, c, t, g, unknown or other
  modified_base (520)..(520): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcgtgggggaggcttggtccgagggtcccgggggggtccctggagactctccgtgtgcagtctctggattccacccttagaagttattggatgaccgtggtcccgccaggctccgaggggaagggctgggaggtggggtggacccaaacgtaataaaacgaaaaggaaccggaagtaccaaaagaaaaaaccctgtagtaggacttcgtgtagaccggccgtaattccaccatcaccagacgaacaacgaccaagaattcactntattgacaatgaaacngctgagaggngagacncggctgtattagttgngcgcgagtatgaagttagacgtactacctagaagttaaggcggtaggtagtagtagtacgttg

SEQ ID NO: 372346 - DNA, 619 bp, Homo sapiens
  misc_feature: GZ8MTXP02FRQKD.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttgggtccgaggccgggggggtccctggagactctcctgtgcagtctctggtattcaccttagaagttattggatgacctgggtccgcaggctcgaggggagggctggaggtgggtgaccaaacataaaacgaaagacggaagtacaagaaaaacctagtgtaggactcgtggtagaccgggccgattccaccctattccaccgaagacgaacaaaccgaccaaaagattaccaactagttatttacgactaaaatcgaaacagtaccctaggaagagggacgggaaggaaccgacgggtccgtagttaatttagttggtcggaccgacggtagagttaggaagttaacggtagaccttacgtaagaaggttagacgtagggtagtatggtatttgg

SEQ ID NO: 372347 - DNA, 892 bp, Homo sapiens
  misc_feature: GZ8MTXP02FNABQ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggagtcggtgggggaggtcgttggtccgacgggccggggggtccctggacgacttctccgtgtgcagtctcgtggtacttcctaacccgttagtaagtttagttaggatcgaccgttcggggtccccgccgacggtcctaccggaagggggaacggggcgtaggggagggtggggtcggacccaaaacgaaactaaaaacgaaaacgggaacgggaaaagtaccgaaaaggaaaaaacccttagtaggtacggtaaccttcgtacggttacgggaacccgggccgtaaatttacccaaaccctaattcccgtacccaaagggaaacgaacccgtaaaaccgaccctaaaaggtaactttacccaacgttaggtttaaattttcggaaaactaaaaacgttcgaaaaaccgacggttaacccgtagggaaacggggaacggggaaccggggaaacgggtaacccgaacccgggggtcccggtttaaggtttaaaaacgtttttacggtttacgggtggggtacccccgggaaacggttaaaggggtacgtttaaacgggtaaaacggtttaaacgggtaaaacgggttaaaaccctttaccgttaaaacccggttaaaggggtaaacggtaacgggttaacggggggtttaaggtttaacggtaaaacggttcgtttttaaaacggggg

SEQ ID NO: 372348 - DNA, 724 bp, Homo sapiens
  misc_feature: GZ8MTXP02HXSXC.15.67.G01.1.454.CMB.2.raw
  modified_base (320)..(320): a, c, t, g, unknown or other
  modified_base (343)..(343): a, c, t, g, unknown or other
  modified_base (460)..(460): a, c, t, g, unknown or other
  modified_base (528)..(528): a, c, t, g, unknown or other
  modified_base (714)..(714): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttatttagaaggtgtccagtgtgaggtgctacgttgggtggaggtcggtgggggaggtcgttggtccgacgggcccggggggtccctggacgactctccgtgtgcagtctcgtggattccaccttagaagttatggatagccgtgggtcccncgaggcctcggaggggaggggcngggtaggtgggtcggaccaaacaaataaaacgaaaggtaacgaaagtacaaaagaaaacctgtagtgtaactgtaggtacgaccggggactattaccaacccgattccgacacgaanaccgaaaccgactaaacgtaacttacctaacgttgtttaagtttacaaacctaaagttaacgaaaacncgggtaccgttaagggaagggaaccgggacgggaaccgggtaaccggtaccgggtacggttagtttaagtttaagtggtttacgggccggacggtaaaagtaggtaactaacgggttaataaacgggtccttaacgttaacggaaggttaaccggacggttaggggttaagtttagtaacggtttntttaacgggg

SEQ ID NO: 372349 - DNA, 725 bp, Homo sapiens
  misc_feature: GZ8MTXP02HQ1QK.15.67.G01.1.454.CMB.2.raw
  modified_base (311)..(311): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttgggtggagtcgtgggggaggcttgggtccagggcccgggggggtccctggacgactctcctgtgcagtctctggattcacccttagaagttatggatgacctgggtccnccgaggctccgaggggaaggggcgtggaggtggggtcggaccaaaactaaataaaaacgaaaaggacggaaagtacgaaaagaaaaaccctagtagtggacttgtggtagaccggggcctaattccgaaccctactcctaccgaagaacgaaaccaaccggaccaaagtaattcctaacttgttaattttcgaactaaaagtacggaaactaaacgcccgttaggaaacgggacgggacgggaacgggaacccgaaaccggggtcccgtttaggttaacgttttaggtttaggtcggccggtaacggaagggttataggtaaacggtttaaaggtacggtaaaacttcccgttaaagtaacggtaaacggtacggtaaggggtttaggttaaggttaaggttaaccgttttggg

SEQ ID NO: 372350 - DNA, 559 bp, Homo sapiens
  misc_feature: GZ8MTXP02GU3FR.15.67.G01.1.454.CMB.2.raw
  modified_base (301)..(301): a, c, t, g, unknown or other
  modified_base (329)..(329): a, c, t, g, unknown or other
  modified_base (370)..(370): a, c, t, g, unknown or other
  modified_base (381)..(381): a, c, t, g, unknown or other
  modified_base (449)..(449): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacctagagttattggatgactgggtccnccaggctccgaggggaagggctggaggngggtggccaacataaacaaagacggaagcaagaaaaacctngtaggactcgngtagacggcgattcactatctccagacacaacgtacaagaattcactgtatttagacaaatgaaacgngtcctaggacggaggacgaaggacacggcgtgtagttagttggtgcggacgagagtacgattacgacgacttaccaagtaagtacgacgtagggagtagtacgagtttcg

SEQ ID NO: 372351 - DNA, 737 bp, Homo sapiens
  misc_feature: GZ8MTXP02HIDQR.15.67.G01.1.454.CMB.2.raw
  modified_base (361)..(361): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcggtgggggaggtcgttgggtccgagggcccgggggggtccctggacgactctcctgtcgctagtctcgtggacttccaccttagtaagttatggatgaccgtggtccgccaggcctcgaggggacgggcgtgggaggtggggtcgaccaaanaaacgtaaaaacgaaacggaaacgggaaagtacgaaaagaaaaaacccttgtagtacggaacttcgtaggtacggaaccgggcctaattaccacctattccaccgaagaacgaaaccaaaccgaccaaaacggtaaactttaccgaacttaggttaattttacgaacaaaagttacgaaaaccgacggtaacctagggaacggaacgggaccgggaaacgggtacccggaaccgggtaccggtttagttaacggtttaagtttacgggtcggacggtaccggaaggtattaacggaacgttaacggtaacgtaaccgttactaaacgtaacggttagaccgggttaagggtaggttaacgttggtacggtttacgg

SEQ ID NO: 372352 - DNA, 594 bp, Homo sapiens
  misc_feature: GZ8MTXP02FNKWE.15.67.G01.1.454.CMB.2.raw
  modified_base (464)..(464): a, c, t, g, unknown or other
  modified_base (524)..(524): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggcgttggtccgagggcccgggggggtccctgagactctcctgtgcagtctctggattcaccttagaagttatggatgactggtccgccaggcctcgagggagggcgtggagtgggtgaccaacaataaacgaaagaccggaaagtacgaaagaaaaaccctatgtaggactcgtagtacggaccgggccgattcacccatcctcaagagacaaacgcaaagattacactgtatttagacaaangtaaacagcctaggagagggacgaagggaccgaacgggccgttgttaaattagtttgggngacggaggtagtatagtagtacgtacgtactacgtagaaggtacgacggtaggtagtagtacgtagttcg

SEQ ID NO: 372353 - DNA, 621 bp, Homo sapiens
  misc_feature: GZ8MTXP02GAJFL.15.67.G01.1.454.CMB.2.raw
  modified_base (314)..(314): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtctttgtccaggcccgggggggtccctggagactctcctgtgcagtctctggtacttcacccttagaagttatggatgaccgtcggtcccgcgnggctccgaggggaagggcgtggaggtgggtcggaccaaacgaaataaaacgaaaaggacggaaagtaccgaaaggaaaaaacctgtagtgaactcgtagtacggaccggcccgaattaccacctatacctaccgagaacgaaaccaaaccggtacccaaataacttactaacctgttaatttagactaaaatagaaacagacctagacggagacggaaggaccgacggcgttagtagtttatggtgccgacgagatgaatagacgtacacgttaagaagttacgacgtaggtagttatggtatttcg

SEQ ID NO: 372354 - DNA, 718 bp, Homo sapiens
  misc_feature: GZ8MTXP02J2JHL.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccgaggccgggggggtcctggagctctcctgtgctagtctcgtggattccacccttagaagttagtgggatcggaccgtgggtccccgcgaggctccgaggggaaggggcttgggaggtgggtggaccaaacaataaaacgaaagacggaaatcgaaagtaaaaccctgtagtaggaacttcgtggttacgaccggggcctacttcactactaccgtacagacgaaaccgaaaccggtacccaaaaggtaacttacctaacgtcgttaattttagggaaaccttaaaagttacgaaacgacgttaccccgtagggaacgggtacggaccgggaaacggtacccgaacggggtcccggttagttaagttacgtttaggcggtacggtaccggaagtagtaacgggtaaaccttagggttaaacgacccttaagttaaccgaaggttaccgaaacggtcggggttaaagggtttccaacggttaccgtttcgg

SEQ ID NO: 372355 - DNA, 536 bp, Homo sapiens
  misc_feature: GZ8MTXP02I7QT6.15.67.G01.1.454.CMB.2.raw
  modified_base (305)..(305): a, c, t, g, unknown or other
  modified_base (333)..(333): a, c, t, g, unknown or other
  modified_base (339)..(339): a, c, t, g, unknown or other
  modified_base (371)..(371): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagttcgtggggggaggcttgggtccaggccgggggggtccctggagactctcctgtgcagtctctggattcaccttagagttatggatgacctggtccncaggctccgagggagggctggagtgggngccaanataaacgaaagacggaatacaagaaaaacctngtggactgtgtgacggcgatcaccatcctacagagacaacgcaaagattcactgtattgacaaatgaaacagcctagagaggcgaacgacgacggacgtgtaattagttgtgcgagagatgaactagtagactctaagaagtcgacgtaggtgtatagtactttg

SEQ ID NO: 372356 - DNA, 640 bp, Homo sapiens
  misc_feature: GZ8MTXP02HNIY4.15.67.G01.1.454.CMB.2.raw
  modified_base (311)..(311): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtgggagtcgtgggggaggcgttggtccgagggcccgggggggtccctggagactctcctgtgcagtctctggattcaccttagaagttatggatgaccgtgggtcccnccagacctccgaggggaagggcgtgggaggtggggtcggacccaaacaagtaaaacgaaaaggaaccggaaagtacaaagaaaaaacctgtagtggaacttcgtagttacggaaccggggcctaattaccgaacctaatcctaccaagaacgaaccaaacgaccaaaagaactactactagttatttagacaaaatagaaacacgtacctaggaaggacgggacggaacggacgaaccgggtccgttagtatttaagttcgacgccggtacgagtagtagtaagtaagtacgaactctaagaagtagacgtaggtagtgagtacgtttg

SEQ ID NO: 372357 - DNA, 584 bp, Homo sapiens
  misc_feature: GZ8MTXP02IH7TB.15.67.G01.1.454.CMB.2.raw
  modified_base (524)..(524): a, c, t, g, unknown or other
  modified_base (536)..(536): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaaggtgtccagtgtgaggtgcacttggtggagtcgtgggggaggcttggtccaggccgggggggtccctggagactctcctgtgcagtctctggattcacccttagaagttattggatgacctgggtccgccaggctccgaggggaacggggctgggagtggggtgccaacataaacgaaagaacggaagtacagaaaaacctagtgtaggactcgtgtacgacgggccgtattaccaccatctccaagacgacaacgtaccaaagaattcaacttgtagtttagactaaaatgaaacacgtacctaggagacgggacgaacgggacgaacggcgttagtattagttgngcgcgtaaaggntagatacgtacgactactacgaagtacgacgtaggtagtatagtactg

SEQ ID NO: 372358 - DNA, 555 bp, Homo sapiens
  misc_feature: GZ8MTXP02F2VM0.15.67.G01.1.454.CMB.2.raw
  modified_base (390)..(390): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctaccgaggggaaggggctgggagtggggtggaccaaacgaataaaacaaaaggaccggaaagtccaaggaaaaaccctntgaggactctgtagacggccgattcaccatctccagacgacaacgtccaaagaattcaactgttatttgacaaaatgaaacagcctgagaggcgagaccacggccgtgtattagtgtgcgcgagatgaactagacgactctagaagtagctaggtgtatgattcg

SEQ ID NO: 372359 - DNA, 722 bp, Homo sapiens
  misc_feature: GZ8MTXP02GILS9.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtggaggtgcacgttgggtggagtcggtgggggaggtcgttgggtccgacgggccggggggtcctggagactctcctgtgcagtctcgtggattccaccttagaagttattggatcgaccgtcgggtcccgccgaggcctaccgaggggaacggggctaggggaggtggggtcggaccaaaacgaaagtaaaaacgaaaacggaaacgggaaagtacgaaaagtaaaaaaccctgtaggtaggacttcgtaggtacgaccggggccgtaatttaccaaccctagtacctaccgaaaggaacgaaacccaaaccgacccaaaaggtaaactttacgaaccttagtttaatttacggaaactaaaagtacgaaaaccgacgtacccgtaggaaggacgggacgggaaaggaaccgaaccgggtccggttagttaagtttagttcgggtgaccggacggaaggaagttaggaaattaaggtaacctaacgttacgaaacgtaaggtacgacgtaaggggtgtaagtgtacgtttagg

SEQ ID NO: 372360 - DNA, 656 bp, Homo sapiens
  misc_feature: GZ8MTXP02GPQAL.15.67.G01.1.454.CMB.2.raw
  modified_base (314)..(314): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcgtgggggaggcttgggtccgagggccgggggggtccctgagactctccgtgtgcagtctctggattccaccttagtaagttatggatcgaccgtcggggtccnccgaggctccgaggggaaggggctgggaggtggggtacgaccaaacgaaataaaacgaaaggaacggaaagtacaaaagtaaaaaccctgtgtaggaacttcgtaggtacggacgggccgattaccaacctatcctaccaagacgaaccaaaccggaccaaagaattcaacttagtatttagaactaaatacgaaatacgaccgtaggaggagggacgaacgggaccgaccgggcgttagttaagtttagttggtacggccggagtaaggattacggaaagtaaggttaccacgtaacgtaagtaacggtagtacggtaggttaggtagtaggtacgtttgg

SEQ ID NO: 372361 - DNA, 580 bp, Homo sapiens
  misc_feature: GZ8MTXP02GFWPY.15.67.G01.1.454.CMB.2.raw
  modified_base (266)..(266): a, c, t, g, unknown or other
  modified_base (301)..(301): a, c, t, g, unknown or other
  modified_base (459)..(459): a, c, t, g, unknown or other
  modified_base (506)..(506): a, c, t, g, unknown or other
tcagtctacgtagccacgaccggtgctcgatttagagtatacatattggggtttgaggtctcagagaggagccttagccctggactccaaggcctttccacttggtgatcagcactgagcacagaggactcaccatggagttggggctgagctgggttttccttgttgttattttagaaggtgtccagtgtgagtgcacttggtggagtcgtgggggaggcttggtccaggccggggggtccctgagactctcctgtgcagtctcnggattcaccttagaagttattggatgacctggccncagctcgaggggaggctggagttgggtgccaacaataaaccgaaagacggaagtacaagaaaaacctgtagtagacttcgtaggtgaccgggcctagttacacccagtcctcagatacaacgcaaagaattcgactgttattcgactaaatcgaaacngacctgaagagggcgaaggaccaacggtcgttagttacttagttggngcgtacggagtagtaggtaataggtactaacttcgtaaacgaagttacgacgtaggttcgtagtggtaattcgg

SEQ ID NO: 372362 - DNA, 596 bp, Homo sapiens
  misc_feature: GZ8MTXP02JR9UC.15.67.G01.1.454.CMB.2.raw
  modified_base (346)..(346): a, c, t, g, unknown or other
  modified_base (377)..(377): a, c, t, g, unknown or other
  modified_base (380)..(380): a, c, t, g, unknown or other
  modified_base (567)..(567): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccaggcccgggggggtccctggagactctcctgtgcagtctctggattcacccttagagttatggatgacctggtccgccaggctccgaggggaagggctggagtggggtggaccaanataaacgaaagacggaatcaagaaaaacctntgnggactctgtgacggccgaattccaccgatcaccagacacaaacgccaaagtaatcgactgtatttgacaaatgaaacagccctaggagacgggaggaacggaaccgaccgggtaccggttggtaacgtttattgggtcgcgttacggagataggattaaggtaccgacgttacgaaccgtggttaanacggtagggtagtaagtcggaagtttcgg

SEQ ID NO: 372363 - DNA, 650 bp, Homo sapiens
  misc_feature: GZ8MTXP02FR3ZK.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaagtgtcagtgtgaggtgcacgttggtggagtcgtgggggaggcgtttggtccgagggcccggggggggttccctggagaccgttctccgtgtgctagttctcgtggtacttccacccttagtaagttattggatgaccgtggtcccgcgaggctccgaggggagggctggaggtgggtcggaccaaagaaactaaaacgaaaggaacggaagtaccaaaaggtaaaaaacccttagtaggtacgaacttctaggttacgaaccggggtcctacttacaccctagtacctacccaagaacgaacaaacccggacaaaacgtacttactactagttatttacgaactaaaatcgaaacgacgacctaggacgagggacggaaggaccgacggtccgtagttagttagttgtacgcgtacgagtattagagtagtaacacgtaccagtaagtacgcgtagggtgtagtggtactttg

SEQ ID NO: 372364 - DNA, 704 bp, Homo sapiens
  misc_feature: GZ8MTXP02IZ9MM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgcagtctctggattcacccttagaagttattggatgaccgtgggtccgccaggctccgaggggaaggggctgggaggtggggtggaccaaacgaataaaacaaaaggaacggaaagtacaaaaggaaaaaacctagtagtaggacttcgtaggtacggaccggggcccgtaagtttacccaaccctaattccgtaccgaagaaacgaaaccaaaccggaacccaaaaggtaaaactttaccaactttaggttaacttttagaaccgtaaaattacggaaaaccacggtaccgttaggacggaagggaccgggaaacgggaaccgaccggggtacccggttaggtaactttgttaggtgtaccggacggagtagtaggtaagttaacggttacgaccttcgtaacgaacggtaaggcgtaggggtaggttacgtaggttaattcgg

SEQ ID NO: 372365 - DNA, 597 bp, Homo sapiens
  misc_feature: GZ8MTXP02HSEPV.15.67.G01.1.454.CMB.2.raw
  modified_base (274)..(274): a, c, t, g, unknown or other
  modified_base (310)..(310): a, c, t, g, unknown or other
  modified_base (330)..(330): a, c, t, g, unknown or other
  modified_base (348)..(348): a, c, t, g, unknown or other
  modified_base (539)..(539): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtcccgagggccgggggggtccctggagactctcctgtgcagtctctggnttcacccttagaagttattggatgaccgtgggtccncaggctccgaggggagggcnggaggtgggtgaccgaanaataaaacgaaagacgggtaaacgtacaaaggtaaaaaccctagtagtacggaacttgtcgttagaccgggtccgattacacctaatcccacagacgaacaacgaccaaagaatctactagttatttgataatagaaacacgacctggagacgggcggacggaccgtaacggcggttagtattaagttcgngcgtacggagtatgatagtacgcttagacaaggttagacgtaggtgtagtagtattcg

SEQ ID NO: 372366 - DNA, 818 bp, Homo sapiens
  misc_feature: GZ8MTXP02G0O6S.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggcccgggggggtccctggagactctcctgtgcagtctctggattccacccttagaagttatggatgaccgtgggtcccgccaggctccgaggggagggcgtgggaggtggggtcggaccaaacaaagtaaaacaaaggaacggaaagtacgaaagtaaaaaacctgtgtaggaactcgtaggtacgaaccgggtccgtaacttaccgaaccctacttccctacccgaaaggaaaccgaaacccgaaacccgtaacccgaaaaggtaaaacctttacccgaaaccgtttacggtttaagttttacggaaaccttaaaagttacgggaaaacctacggtacccgttaagggaaaggggacgggaaccggggtaaacgggaaacccgtaccggggtaccccgggtttaaggtttaaacggttttaagttttgggacgggtcgggtaaccggggtaaagtaacggttaacggtaaacggtttaaaggtaaaccggttaacccttacccggttaaaaccgtaacggtttaaaggaaccgggttaaacgggggtttaacgggtttacgttaacggggttaacttttacgggg

SEQ ID NO: 372367 - DNA, 684 bp, Homo sapiens
  misc_feature: GZ8MTXP02IYJTP.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgagggcccggggggtccctggagacctctcctgtgcagtctcgtggacttccacccttagaagttagttggatgaccgtcgggtcccgccgacggcctccggaggggaacggggctgggaggtggggtcggacccaaaacgaaataaaacgaaaacggaacgggaagtaacaaaggaaaaaacccttgtaggtacggacttcgtaggtacggtaaccggggcctaacttccgaaccctacttcctacccgaagaacgaaaccaaacccgaacccgaaagtaaacttacctaacgtacgttatttagaactaaagtacgaaacgacgtccgtaggaggacgggacgaacggaaccgacggtaccggttagtagtttagtgtacggccgtacggagtaagtgtaagtagtacgtaactcgtaaacaagtagtacgtagggtagttagtagagtttcgg

SEQ ID NO: 372368 - DNA, 611 bp, Homo sapiens
  misc_feature: GZ8MTXP02F9XBD.15.67.G01.1.454.CMB.2.raw
  modified_base (560)..(560): a, c, t, g, unknown or other
  modified_base (593)..(593): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttgggtccgagggcccgggggggtccctggagactctcctgtgcagtctctggattcacccttagaagttattggatgacctgggtccgccaggctccgaggggaaggggctgggaggtggggtggaccaaacaataaaacgaaaaggaacggaaagtacaaagaaaaacctagtgtaggacttcgtaggtacggaaccgggccgaatttccaaccctatcctacccgaagaacgaaccaaaccgacccaaaagaaacttccaacttgttaatttgactaaaatgaaaacagcctaggagagggacggaggacgacggcgttagtattagtgtgcgngagatgataagtagtactactaacgaagtacgngtaggtggtatgatttgg

SEQ ID NO: 372369 - DNA, 676 bp, Homo sapiens
  misc_feature: GZ8MTXP02IMCB7.15.67.G01.1.454.CMB.2.raw
  modified_base (533)..(533): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttatttagaaggtgtccagtgtgaggtgcacgttgggtggagtcggtgggggaggcgtttgggtccgacgggcccgggggggttcccctggagaccgttcctcctgtgcagtctcgtggattccacccttaagaagtttatggatgaccgttgggtccgccgaggctaccgaggggaaggggctgggaggtggggtcgaccgaaaacaagtaaaacgaaaaggaacggaagtacgaaagaaaaaaccgtagtagtaggaacttcgtaggttacgaccggggtccgtaacttccgaacccagtcctaccaaggaacgaacaaaccggacaaagtaaacttctaacgtgttatttacgactaaaagtanaaacgacgtaccgtaggaaggacggacgggaacggaaccgacggtccggttagttaaagtttgttaggtggaccgtacggaagtgtagtaaagtagtacgaaacttcgaacgtaaggtagacgtagggtagtatagtagtttg

SEQ ID NO: 372370 - DNA, 638 bp, Homo sapiens
  misc_feature: GZ8MTXP02I4A4G.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggtcgttgggtccgagggcccgggggggtccctggagacctctcctgtgcagtctctggattcaccttagagttattggatgaccgtggtccgccgaggcctccggaggggaagggctgggaggtggggtcggaccaaacgaataaaacgaaaaggaacggaaagtacaaaagtaaaaacctagtacggtagaacttcgtaggtacggaccgggccgtaacttccacctaatcctaccgagaacgaacaaaccgaccaaagtaacttcacttgttactttagactaaatacgaaacacgtacctaggaggaggacggaaggaccgacggtacgtagttaagttgttggtgcgacgagtagtacgtaattaagtacgacttacgaagaagtaacggacgtaggtagtagtacgtattcg

SEQ ID NO: 372371 - DNA, 665 bp, Homo sapiens
  misc_feature: GZ8MTXP02G1OPI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttgggtggaggtcggtgggggaggtcgttgggtccgagggcccgggggggttccctggagtaccttcctccgtggtgcagtctcgtggattcacccttagaagttattggatgacctgggtccgccaggctccgaggggaaggggcgtggaggtgggtggccaaacgaataaaacgaaaaggacggaagtacgaaagaaaacctatagtgactcgtgtacgacgggccgtattcaccgatcctacagagaaccaacgacaaagattcactgttatttagacctaaaagtacgaaacgacgaccgtaggaacggacggacgggaaacggaaccgtacccgggaccggttagttaagtttaagttgggtacgtacggaccggtaaggtagtacggtaagttaaacggtacgtaacgttacaaccgtaaggttaacgacggttaggggtggtacgtaggtactttggg

SEQ ID NO: 372372 - DNA, 623 bp, Homo sapiens
  misc_feature: GZ8MTXP02IBJKG.15.67.G01.1.454.CMB.2.raw
  modified_base (511)..(511): a, c, t, g, unknown or other
  modified_base (565)..(565): a, c, t, g, unknown or other
  modified_base (570)..(570): a, c, t, g, unknown or other
  modified_base (574)..(574): a, c, t, g, unknown or other
  modified_base (591)..(591): a, c, t, g, unknown or other
  modified_base (614)..(614): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttatttagaaggtgtccagtgtgaggtgcacgttggtggagtcgtgggggagcttggtccaggccggggggtccctgagactctcctgtgcagtctctggattcaccttagagttatggatgaccgtggtccgccaggcctccgaggggagggctgggaggtggggtgaccaaacaataaaacgaaaggaacggaagtacaaaggtaaaaaccctagtagtacggtactcgtaggttacggaccgggtcctaattccgaacccaatccgtaccaggaaccgaccaaaccggtacccaaagtaaacttcctaaacgttcgtttatttacgaactaagtagaaaccngacctaggaggaggcgaaggccacggggtcttaggttaattgttggcgtaccgngaagngtanaagttagtacacccttnacgaagttgacttaggggattanggtacgttg

SEQ ID NO: 372373 - DNA, 655 bp, Homo sapiens
  misc_feature: GZ8MTXP02H6PW5.15.67.G01.1.454.CMB.2.raw
  modified_base (308)..(308): a, c, t, g, unknown or other
  modified_base (340)..(340): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttgggtggaggtcgtggggggaggcttggtccgagggccgggggggtcctgagactctctgtgcagtctcgtggacttcaccttagaagttattggatgaccgtggtccncaggctccgaggggagggctagggagtgggtnaaccaaacaataaaacgaaaggacggaaatacaaaagtaaaaaccctagtggtaggaactcgttaggacgaccgggccaattccgacctatcccacagacgactaacgacccaaagtattccattaggttattacggaactaaagcgaaaacgagtcccgtaagggaaggacgggacggtaaccggaaacggaccgggtaccgggttattaaacgtttagtccggtaggacgtacgggataaggttcaaagtacggtaacgacctttacgaaaaccgtggttaaacggtaggtaaggtcgtaagttgtacgtttg

SEQ ID NO: 372374 - DNA, 565 bp, Homo sapiens
  misc_feature: GZ8MTXP02GDW5X.15.67.G01.1.454.CMB.2.raw
  modified_base (422)..(422): a, c, t, g, unknown or other
  modified_base (457)..(457): a, c, t, g, unknown or other
  modified_base (467)..(467): a, c, t, g, unknown or other
  modified_base (495)..(495): a, c, t, g, unknown or other
tcagtctacgtagccacgaccggtgctcgatttagagtatacatattgggtttgaggtctcagagaggagccttagccctggactcccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgcaggctccgaggggaacgggctggaggtgggtggccaaacataaaacaaaaggaccggaaagtaccaaggaaaaaaccttagtagtcggactcgtagtagacgggccgattcgaccanctccagagacaaacgcaaagatcactgtatttganaaatgaaacngacgtagagaggacgaggacgacgcgtntattagtgtgcgacgagatagtacgtagtacgtactacgtaagaagtacgacgtaggtgtacagtacgtg

SEQ ID NO: 372375 - DNA, 583 bp, Homo sapiens
  misc_feature: GZ8MTXP02GH03U.15.67.G01.1.454.CMB.2.raw
  modified_base (425)..(425): a, c, t, g, unknown or other
  modified_base (467)..(467): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttatttagaaggtgtccagtgtgaggtgcacttggtggagtcgtgggggaggtcgttgggtccgaggggtcccgggggggtcccctggacgtacctcctccgtggtgctagtctcgtggtattcacccttagaagttatggatgacctggtccgcaggctcgagggagggctggagtggtcgacaacaataaacaaagacgaagtcaagaaaaacctgtagtgactcgtgtacgaccggcattacacctatctacaganaccaaacgcaaagtaatcactgttattacgacaaatgaaacngacctgagagacggagacgacggcgtgtaattgtgtagcgacgtagagtacgtagtaacgtacgtacctacgtaacgaacgttacggacgtagggttagtacgtaggtatttacgg

SEQ ID NO: 372376 - DNA, 593 bp, Homo sapiens
  misc_feature: GZ8MTXP02J5EXH.15.67.G01.1.454.CMB.2.raw
  modified_base (431)..(431): a, c, t, g, unknown or other
  modified_base (479)..(479): a, c, t, g, unknown or other
  modified_base (484)..(484): a, c, t, g, unknown or other
  modified_base (494)..(494): a, c, t, g, unknown or other
  modified_base (549)..(549): a, c, t, g, unknown or other
  modified_base (559)..(559): a, c, t, g, unknown or other
tcagtctacgtagccacgaccggtgctcgatttagagtatacatattgggttttgaggtctcagagaggagcccttagcccctggactcccaaggcctttccacttggtgatcagcactgagcacagaggactcaccatggagttggggctgagctgggtttttccttgttgttatttttagaaggtgtccagtgtgaggtgcacttggtggagtctgggggagcttgggtccaggcccggggggttccctgagactctcctgtgcagtctctggattcaccttgaagttatggatgacctgggtccgccaggctccgagggggagggcgtgggagtgggtaggccaaacataacacgaagaacgaacgagtaaccaagtactgaacgttgtcggttacgtcgtacgtacgtcgaccgtactactccgacncgaccaggaccaagacttacgactaactattagtacgtattatcgaanacganacgacgacgnggacggcggttacggataacggtccgttatggtaacttcggtagcgttagacggntacggaattntacgaattcgacacgtaagtccgagtggtttaag

SEQ ID NO: 372377 - DNA, 605 bp, Homo sapiens
  misc_feature: GZ8MTXP02FRM6E.15.67.G01.1.454.CMB.2.raw
  modified_base (303)..(303): a, c, t, g, unknown or other
  modified_base (381)..(381): a, c, t, g, unknown or other
  modified_base (479)..(479): a, c, t, g, unknown or other
  modified_base (563)..(563): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtggaggtgcacttggtggagtcgtgggggaggcttggtccaggccgggggggtccctgagactctcctgtgcagtctctggattcacccttagagttatggatgacctggtccnccaggctccgaggggagggctggaggtgggtggccaacaataaaacgaaaaggacggaaagtacaagtaaaaaacctntagaggactctaggtagaccggggccagttacacccagtcctccgaagacgaacaaacctacccaaagaacttacactgttaaatttgaactaaaagngaaacagcctaggaagaggaccgaaggaccgaacgggtccgtaggtaattagtgtgccgacgagtagtacgatagacgttaccnttaacgaaggtacgacgtaggggtagtaagtgtagtttaccg

SEQ ID NO: 372378 - DNA, 533 bp, Homo sapiens
  misc_feature: GZ8MTXP02IK4BD.15.67.G01.1.454.CMB.2.raw
  modified_base (304)..(304): a, c, t, g, unknown or other
  modified_base (336)..(336): a, c, t, g, unknown or other
  modified_base (364)..(364): a, c, t, g, unknown or other
  modified_base (373)..(373): a, c, t, g, unknown or other
  modified_base (452)..(452): a, c, t, g, unknown or other
  modified_base (512)..(512): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggggtgagctgggttttccttgttgttattttagaaggtgtccagtgtgaggtgcacttggtggagtcgtgggggagcttggtccaggcccggggggtccctgagactctcctgtgcagtctctggattcacccttagaagttattggatgacctgggtccncaggctccagggagggctggagtggtgccaanataaacaagacggaagtcaagaaaactntgtgactcngtgaacgcgattcaccatcctacagacacaacgaccaaagaatacactagtatttgacaaatagaacagcctgaaaagnggacgaggacgacgcgtgtattattgtgcgcgagatgagtagtagactactacagtaagngaggtggtatagtatgtttag

SEQ ID NO: 372379 - DNA, 754 bp, Homo sapiens
  misc_feature: GZ8MTXP02IVM62.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtcgtgggggaggcttggtccgaggccgggggggtccctgagaatctcctgtgcagtctctggacttcaccctagaagttattggatgaccgtgggtccgccgaggctaccgaggggaagggcgtggaggtggggtacggaccaaacgaataaaacgaaacggaacgggaagtaacgaagtaaaaacctataggtagtaaccttcgtaggtacggaacgggtcccgtaactttaccgaaccctattacccgtaccgaaagtaaaccggaaaccaaaccggaacccgaaaagtaaacgtttccaaaccgtttacggttaaatttttacgggaaactaaaatcgggaaaacgtacggtacccgtaggaacggacggggacggtaaacgggggaaccctaccgggggtaccgttaggttaaacgtttagtttaggtcggaccggacggtaaaggagtttaacggagttaaaaggtttacgaccgttttacctaaaacgaaggtaacggtacggtaaaagggggtttagttaacgttggtacgtttacgg

SEQ ID NO: 372380 - DNA, 543 bp, Homo sapiens
  misc_feature: GZ8MTXP02I11FJ.15.67.G01.1.454.CMB.2.raw
  modified_base (301)..(301): a, c, t, g, unknown or other
  modified_base (488)..(488): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagagttatggatgacctggccncaggctccgaggggaggggctggagtgggtggccaacataaacaaaggacggaagtcaagaaaaacctagtagtggactctgtacgacggccgattccaccatctacagagacaaacgcaaagaattcacttgtatttgacaaatgaaacagccgtagagaggcgaggacgacggcgtgtattatgngcgcgagatgatagtacgacgtctacgaagtacgacaggtgtacgtagagtttcg

SEQ ID NO: 372381 - DNA, 708 bp, Homo sapiens
  misc_feature: GZ8MTXP02JK80N.15.67.G01.1.454.CMB.2.raw
  modified_base (366)..(366): a, c, t, g, unknown or other
  modified_base (391)..(391): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggaggttggggctgagtcttgggttttccttgttgtttatttagaaggtgtccagtgtgaggtgctacgttgggtggaggtcggtggggggaggtcgttgggtcccgacggggtccccgggggggtccctggacgtaccttcctccgtggtgctagtctcgtggtacttcctacccttagtaagttattggatcgaccgtggtcccgcacggctccgagggggaagggtcnggggtaggtggggtacgacccaaanaaagtaaaacgaaaggaacggaatacgaaagaaaaaacctgttgggtacggcttcgtgggacgaccggggccgtaattaccgaccctattccaccaaggaccaaccaaccgaccaaaagtaacttactacttaggttaacttttaggaactaaaaagttcggaaacacggtaccctaggggaacggacggggacgggacggtaaccgaccgggtaccggttagttatttaggttgtacgcggacgtaggattaggaatacgggtacgtactccgtaataacggtaggtacgtacggggttaggtatagttacgtttg

SEQ ID NO: 372382 - DNA, 576 bp, Homo sapiens
  misc_feature: GZ8MTXP02HG3TG.15.67.G01.1.454.CMB.2.raw
  modified_base (344)..(344): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaaggggctggagtggggtggccaanataaacaaagacggaagtcaagaaaaacctatagtgactgtgtgacggccgattccaccatctaccagagacaaacgccaaagaattcactgtatttgacaaatgaaacagaccctgagaggcgaaggaccaacggccgtagtaacgtttatggtgcggtcgagtataggaattaaggtacgtaactacgtacgaaggtagtaccgagggttaggtacgtagtaagtttcgg

SEQ ID NO: 372383 - DNA, 671 bp, Homo sapiens
  misc_feature: GZ8MTXP02HRE8W.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccgaggtccggggggtccctggagactctcctgtgcagtctctggattccaccttagaagttatggatcgaccgtggtccgcaggctccgaggggagggctgggaggtgggcggaccaaagaataaaacgaaaaggacggaaagtacaaaacgtaaaaacctagtaggtaggaccttgtacggtacggaaccggtccgtaaacttaccaaccctatcccgtaccgaagaacgaaacccgaaaccgtaacccaaaagtaactttacgaacttagttatttaacgactaaaagtacgaaaaccgacgtacccgtaggaaggaacgggacgggaacggaaccgacgggtaccgtaagttagttacgttggtagcggacgtagtatacgtaaagttagtaacgtaccttacgtaacgaagtagacggtagggtaagtgtagtagtttccg

SEQ ID NO: 372384 - DNA, 646 bp, Homo sapiens
  misc_feature: GZ8MTXP02GU90K.15.67.G01.1.454.CMB.2.raw
  modified_base (312)..(312): a, c, t, g, unknown or other
  modified_base (509)..(509): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctggagactctcctgtcgcagtctcgtggacttcacccgttagaagttattggatgaccgtgggtccnccgaggcctccgaggggacgggctagggaggtgggtcggaccaaacgtaagtaaaaccgaaaaggacggtaaatacgaaagaaaaaaccctgtaggtaggacttcgtggtaggaccggcgtacttaccaccgatctacacggacgacaaacgaccaaagtaacttcgaatcgttaatttcgactaaaatcgaaaacngaccgtaggaggacggacgggagtaccgacgggccgttagttagttattggagtcggacgaaggtatacgtattaaaggtcgtaactccgtaagaacggttaagaccggtagggtaggtacgttacggaactttcgg

SEQ ID NO: 372385 - DNA, 545 bp, Homo sapiens
  misc_feature: GZ8MTXP02I1SIW.15.67.G01.1.454.CMB.2.raw
  modified_base (305)..(305): a, c, t, g, unknown or other
  modified_base (344)..(344): a, c, t, g, unknown or other
  modified_base (415)..(415): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgatccaggccgggggggtccctgagactctcctgtgcagtctctggattcacccttagaagttattggatgacctgggtccnccaggctccgagggaaggggctggagtgggtggccaaanataaaacaaagacggaaagtcaagaaaaactatgtaggactctgtgaacggccgattcaccatctccaganacaacgccaaagaattcactgtactttgacaaatgaaacagacctagaggaggaccgaggacacggccgtagtattaatcgtgcgcgagatagatacgtaagactactaacagtagcaggtggtatggta

SEQ ID NO: 372386 - DNA, 585 bp, Homo sapiens
  misc_feature: GZ8MTXP02JJK78.15.67.G01.1.454.CMB.2.raw
  modified_base (388)..(388): a, c, t, g, unknown or other
  modified_base (467)..(467): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccggggggtccctgagactctcctgtgcagtctctggattccacccttagaagttattggatgaccgtgggtcccgccgaggcctccgaggggaacggggctgggagtggggtggaccaacgataaaacaaagacggaagtacaagaaaaaccctntagtgactcgtgtacgacggccattccaccatctccagacgacaacgaccaagaacttcactgtatttgacaatgaacngctgagagcgagacgacggccgtagtattacgtgtcgcgtacggagtagtaggtaagtacggtacgtaacctcgtaacctaaggtagaccgtaggggtaggttaagtggtactttagg

SEQ ID NO: 372387 - DNA, 548 bp, Homo sapiens
  misc_feature: GZ8MTXP02GMR90.15.67.G01.1.454.CMB.2.raw
  modified_base (459)..(459): a, c, t, g, unknown or other
  modified_base (496)..(496): a, c, t, g, unknown or other
  modified_base (529)..(529): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattcacccttagaagttattggatgacctgggtcccgccaggctcccgaggggaaggggctgggaggtggggtggccaaacataaaacaaaggacggaagtacaagaaaaacctatagtggactctgtgacggccgattccaccatctcagagacaacgcaagatcactgtatttgctaaatgaaacancctgagaggcgaggaccacggcgtgtattatgtgcgngagatagatagtacgactcgtaacaagttacgngtagggtgtaatgaattgg

SEQ ID NO: 372388 - DNA, 708 bp, Homo sapiens
  misc_feature: GZ8MTXP02JFWNG.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcgttgggtccgagggcccggggggtccctggagacctctccgtgtgcagtctcgtggattctacccttaagaagttagttggatgaccgtgggtccgccgaggcctccgaggggaaggggcgtgggaggtggggtcggaccaaacgaagtaaaaacgaaaaggacggaaagtacgaaaaggaaaaaccttagtaggtacggtactacgttaggacggaccggggccgtaattcccgaacctactcctaccagaacgaccaaacgaccaagaaacttctactgttaatttacgactaaaagtcgaaacacgtaccgtagaagggacggacggaacgggaaccgacgggtaccgttaggttaaagttgtttacggtcggaccggacggtaagtaacgaacggttaattaaacggttacgtaaaacccttcgtaaaccggtaagtaacggtaacggttaggggttaaggttaacgttcggtaaagtttcggg

SEQ ID NO: 372389 - DNA, 546 bp, Homo sapiens
  misc_feature: GZ8MTXP02HZ1YB.15.67.G01.1.454.CMB.2.raw
  modified_base (459)..(459): a, c, t, g, unknown or other
  modified_base (523)..(523): a, c, t, g, unknown or other
tcagtctacgtagccacgaccggtgctcgatttagagtatacatattgggtttgaggtctcagagaggagcccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctccgaggggaggggctgggagtggggtgacccaaacataaaacgaaagacggaagtacaagaaaaacctagtgtggactcgtgtgacggccgtattcacctatctacagagacaacgccaaagacttcactgtattgacaaatgaaangcctgagagcgagacacgtcgtgtaacttgtgtgccgtagagtatgaatagtacgacttcaagngtacgcgtaggtgtatgaattcg

SEQ ID NO: 372390 - DNA, 624 bp, Homo sapiens
  misc_feature: GZ8MTXP02GMIXL.15.67.G01.1.454.CMB.2.raw
  modified_base (265)..(265): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgtttattttagaaggtgtccagtgtgaggtgcacttggtggagtcgtgggggaggcttggtccgagggcccggggggtccctgacgactctcctgtgcngtctcgtggtacttccacccttagaagttagttggatcgaccgtgggtccgccaggctccgaggggaagggcgtggaggtgggtgaccaaagaataaaacgaaaggaacgaaagtacgaaaagaaaaacctgtagtaggtactcgtagtaggaccgggcattccgaccattcaccgagaacgactaaacccgacaaagtaacttacacgttgttaatttacgaactaaagtacgaaacacggacctaggaggaggaccgtaggaccgacggtccgtagttaattgtgtgacgagagtagtagagtaagtacgactacgttaacgaagttagacggtaggttaggtataggttacgtttg

SEQ ID NO: 372391 - DNA, 632 bp, Homo sapiens
  misc_feature: GZ8MTXP02I4IRG.15.67.G01.1.454.CMB.2.raw
  modified_base (492)..(492): a, c, t, g, unknown or other
  modified_base (539)..(539): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggcccgggggggtccctggagactctcctgtgcagtctctggattcacccttagaagttattggatgaccgtcgggtccgccaggctccgaggggaaggggctggaggtgggtggaccaaacataaaacaaaggacggaagtacaagaaaaacctagtggtaggacttcgtaggtagaccgggccgtaattccacctatcctaccagaacgaaccaaccgacccaaagtaacttacactagttatttgactaaaatgaaacngacctgagaggcgaaggacgacgggaccgttgtagttacgtttgggngacggacggagtagtacgtaaagtacggtaacgtaacgttacgtaaacgtaacggtaacggacggtagggttaggtaagtaggtaacgtttgg

SEQ ID NO: 372392 - DNA, 673 bp, Homo sapiens
  misc_feature: GZ8MTXP02JV4GM.15.67.G01.1.454.CMB.2.raw
  modified_base (471)..(471): a, c, t, g, unknown or other
  modified_base (532)..(532): a, c, t, g, unknown or other
  modified_base (575)..(575): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgctacgttgggtggagtcgtgggggaggtcgtttggtccgagggcccggggggtcctggagtctctcctgtgctagtctcgtggacttcctaaccgttagaagtttagttggatcgtaccgtcgggtccccgcgacggcctccggaagggggaacgggtcgtaggggaggttgggggtacggacccaaaacgtaaagtaaaacgaaacggaaacggtaagtacaaaagtaaaaacctagtgtaggacttcgtaggacggacgggctattccgactntctacagacacgaaccgacgaatacttaccagttagttatttagaactaaagtacgaaacncgaccgtaggagtacggacgggaacgacgacggtcgtaagttnttaggtgtacgcgtaggagtagtaaggtaaagtgtaaacgtaccttaccgtagaaggttacgacggtaggggttacgtaaaggttcgttaacgtttgg

SEQ ID NO: 372393 - DNA, 591 bp, Homo sapiens
  misc_feature: GZ8MTXP02JK6XH.15.67.G01.1.454.CMB.2.raw
  modified_base (382)..(382): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggtccctgagactctcctgtgcagtctctggattcaccttagagttattggatgacctgggtccgcaggctccgaggggaagggctggaggtggggtggaccaaactaataaaacgaaagaccggaagtacaagaaaaaccctntagtggactctagtcgacggcgattccgaccatctaccagaacgacaaacgaccaaagattcactgtatttgacaaatgaaacacgcctgagacggacggaacggaccgtacggaccgttagtactttagttggtcgcgtacggagtactcgaaagttacggtaacactccttaagaagtaacgacgagggtaggtaatacgagtttcg

SEQ ID NO: 372394 - DNA, 580 bp, Homo sapiens
  misc_feature: GZ8MTXP02JD10J.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgacctgggtccgccaggctccgaggggaaggggctgggagtggggtggaccaacgataaaacaaagacggaaagtcaagaaaaaccctagtagtaggaacttcgtggtgaccggggccgaagttccaccgaatcctacccgagacgacaaacgacccaaagaattcactgttatttagacaaatcgaaacagtcctagagaggcgagacgacggctagtatagtgtagccgagagatggaatagtagtacctctaacgaagtcgactaggggtgtaactggaatttg

SEQ ID NO: 372395 - DNA, 596 bp, Homo sapiens
  misc_feature: GZ8MTXP02G7V97.15.67.G01.1.454.CMB.2.raw
  modified_base (288)..(288): a, c, t, g, unknown or other
  modified_base (302)..(302): a, c, t, g, unknown or other
  modified_base (487)..(487): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccggggggtccctggagactctcctgtgcagtctctggattcaccttagaagttntgatgactggtccnccaggctcgaggggagggctgggagtgggtcggaccaacaataaacgaaagaacggaagtacaaaggaaaaacctgtgagtactcgtgtaggtaccggccgtaattccaacctactaccctaccaagaacgaaccaaaccggaccaaaagaactttacacttagtaatttgacaaagtagaaacngacctaggagaggcggaagaccgacggtacgtagtagtttattgtgaccgagagataggtaatacgtaagacctaactacgaagttagcgtaaggtgtagtagagttcg

SEQ ID NO: 372396 - DNA, 600 bp, Homo sapiens
  misc_feature: GZ8MTXP02I7YXI.15.67.G01.1.454.CMB.2.raw
  modified_base (441)..(441): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatgggagttggggctgagctgggttttccttgttgttattttagaaggtgtccagtgtggaggtgcacgttgggtggaggtcggtgggggaggcgttgggtccgagggcccgggggggtccctggagactctcctgtgcagtctctggattcacccttagagttattggatgacctggtccgccaggctccgaggggaaggggcgtggaggtggggtggaccaaacaataaaacgaaaaggaacggaaagtacaaaggaaaaacctagtagtaggactctgtgaccggccgattcaccatctacaganacaaaccaccaaagaatcatcgtatttgacaaatgaacagacctagagaaggacggaaggaccgacgggaccgtaggtacttagttgtgcgacggagagttggaattagtacgtaactactacgaagttacgacggtaggtaggtatacggtatttacg

SEQ ID NO: 372397 - DNA, 712 bp, Homo sapiens
  misc_feature: GZ8MTXP02HXUZ1.15.67.G01.1.454.CMB.2.raw
  modified_base (344)..(344): a, c, t, g, unknown or other
  modified_base (378)..(378): a, c, t, g, unknown or other
  modified_base (421)..(421): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctcctgtgcagtctctggattccacccttagaagttatggatgaccgtgggtccgccaggctccgaggggagggctggagtgggtggccaanataaaacaaagacggaagtacaagtaaaaacctntgtaggacttcgtaggttacgaccgggccgaattccgaacccnttaccctaccgaagacgaaccaaaccggacccaaagtaaacttactacgttagtttagtttacgaaccgtaaaagttacgaaaactaacggaccccgttaggaacgggacgggaccggaacggggaaaccccggtaaccggggtcccggttaggtttaaacgttttaacggtttcggtacggttacccggaccggtaaggtaaagttcggtaaagttaaaggttaacggtacctttaccgaaaccgtaaggttaagaccgtaagggtagggttatttacggtaactttcgg

SEQ ID NO: 372398 - DNA, 592 bp, Homo sapiens
  misc_feature: GZ8MTXP02JWRRZ.15.67.G01.1.454.CMB.2.raw
  modified_base (491)..(491): a, c, t, g, unknown or other
  modified_base (505)..(505): a, c, t, g, unknown or other
  modified_base (582)..(582): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgagggccggggggtccctgagactctcctgtgcagtctctggattccacccttagaagttagttggatcgacctgggtcccgccaggctccgaggggagggctgggaggtgggtcggaccaaacaataaaacgaaagaacggaaagtacaaagaaaaaacctgtaggtagactctggtagaccgggccgattccacctatcctaccgaagacgaaaccaaacgacccaaagtaacttcactgtatttagacaaatagaaacngacctaggagaggnggaaggactacggccgtagttattagttgtacgcgcgagatgagtagacgactactacgaagtacgagtaggtgtancggtatttgg

SEQ ID NO: 372399 - DNA, 758 bp, Homo sapiens
  misc_feature: GZ8MTXP02GNF0J.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccggggggtccctgagactctcctgtgcagtctctggacttcacccttagaagttattggatgaccgtgggtccgccgaggctccgaggggaaggggctggaggtggggtgaccaacaataaaacgaaaggacggaaagtacaagaaaaacctgtagtaggactcgtaggtacgaccgggcctaagtttccaccctaattcctacccgaaggaaacgaacccgaaaacccggacccaaaaggtaaacttacctaaccgttacgtttaagttttacgaaacctaaaaagttacggaaaaccgaacggtaccccgtaagggaacgggaacggggaccgggaaggggaaaccccgtaccgggggtacccggtttaggttaacgttttaacggttagggttcggtacccggaacgggtaaggtaagttacggtaaagtttaaggtaaacgtaaccgtttacccgttaaacgtaaggtttaacggaccggttaagggggttaggtttaacgtacggttaacgtttttacgg

SEQ ID NO: 372400 - DNA, 736 bp, Homo sapiens
  misc_feature: GZ8MTXP02HZOJI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggaggtcgtgggggagcgttggtccgagggcccgggggggtccctggagactctcctgtgcagttctcgtggacttcctacccttagtaaagttgttggactgaccgttgggtcccgcctaggcctccggaggggaaggggcgtagggaggtgggtaggaccccaaaacaagtaaaaccgaaaaggaacggaaagtaccaaaagaaaaacccgttagtaggtacgtaacgtcgttaggtacggaccggggtcccgtaatttaccgaccctacttcctaccgagaacgaaaccaaaccgacccaaagtaaacttaccctaacgtttacggttaattttcggaaactaaaacgttacggtaaacgaccggtaccgttacgggaaagggaccgggacggggaaaccggaacggtaacccggggtaccggtttacgttaagtttacggttaggtggtccggacgtagtaggtagacgtttaagacgtaacttaccgtaagaaggttaggacgtagggtagtacgtaggtagtttg

SEQ ID NO: 372401 - DNA, 785 bp, Homo sapiens
  misc_feature: GZ8MTXP02I5WFJ.15.67.G01.1.454.CMB.2.raw
  modified_base (335)..(335): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccgaggcccgggggggtccctggacgactctctgtgcagtctctggattcaccttagaagttattggatgacctgggtccgccaggctccgaggggaacggggctagggnggttggggtacggccaaacgaaataaaacgaaaaggacggaaagtaccaaagaaaaaacctgtaggtaggaacttcgtaggttacggaaccggggtccgtaactttacccaaccctaacttacccgtacccaaggaaacgaacccaaaaccggacccgaaaagtaaacttacaaccgttggtttaaacttttggaacctaaaaagtcggaaaactaacggtacccttaaggaacggggaacggggaccggggaaacgggtaacccggaacccggggtacccgggtttaagggtttaaaccttttaaggtttgggttacggtacccgggtacggaaaacgggtagttacggtaaaagttaaacgggtaaacgtaaacgtttccggtaaaacgtaaccggttaacggaacgttacgggggtaggtttaaacgtacggtaacgtttttacggg

SEQ ID NO: 372402 - DNA, 686 bp, Homo sapiens
  misc_feature: GZ8MTXP02FTBAF.15.67.G01.1.454.CMB.2.raw
  modified_base (196)..(196): a, c, t, g, unknown or other
  modified_base (591)..(591): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtncacgttgggtggagtcggtggggggagtcgttgggtcccgacgggcccgggggggtccctggacgactctcctgtgcagtctctggattcacccttagtaacgttagttggatagaccgtcgggtcccgccgacggcctaccgagggggaaggggcgtgggtaggtggggtcggacccaaacgaaataaaaccgaaaaggaaacggtaagtacgaaacgtaaaaaacctagtagtacggacttacgtgttacggacgggccgtaattccaacccatacctaccgaagacgaaccgaaacgacccaaaagtacttactactagttattgtaacaaaatagaaacacgtaccaggaggacggagaacgggaccgacgggtccggttagttaagtttnttagggtcgacggtacggaggtagtagaacgttaaagtacggacttacgtaacgtaaggtaggaccggtagggttagtaagttaggaattttcgg

SEQ ID NO: 372403 - DNA, 788 bp, Homo sapiens
  misc_feature: GZ8MTXP02FRDUT.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtccctgagactctcctgtgcagtctctggacttcaccttagagttatggatgacgtggtccgcaggctaccgagggagggctggagtgggtcgaccaagaataaacgaaagacgaagtacaagtaaaacctagtgtacgactcgtaggtacggaccgggtccgtaattaccgaacctacgttacctaccgaaggtaaaccgaaccgaaaccggacccgtaaaagaaaccgtttccgtaaaccgttaggtttaacgttttaacgggaactaaaaacgttcggtaaaacccgtaacgggtaccccgttaaggggaaacggaccgggggttaaccgggaaaccggggtaaacccgtacccgggggttacccgtttaggggtttaaaactttacgggtttaacgggttccggacccgggtaaccgggtaaacgttaaggttaccggtaaaagttaaacgggttaaccggtaaccgttaacccgttaaaggtaaccgggttaaggaacccggttaagggggttaccggtttaaacgtggtaaacccggttttcgg

SEQ ID NO: 372404 - DNA, 585 bp, Homo sapiens
  misc_feature: GZ8MTXP02GJI7Q.15.67.G01.1.454.CMB.2.raw
  modified_base (307)..(307): a, c, t, g, unknown or other
  modified_base (383)..(383): a, c, t, g, unknown or other
  modified_base (422)..(422): a, c, t, g, unknown or other
  modified_base (530)..(530): a, c, t, g, unknown or other
tcagtctacgtagccacgaccggtgctcgatttagagtatacatattgggtttgaggtctcagagaggagccttagccctggactccaaggcctttccatttggtgatcagcactgagcacagaggactcaccatggagttggggttgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgaccgtgggtcccnccgaggctccgaggggaaggggctggagtgggtggaccaacataaaacgaagacggaagtacaaagaaaactatgnggactcgtgtacggaacgggccgtattccacctattccnccaagacgaacctaaacggacccaaagaacttacacttagttactttagacctaaaatgaaacagcctaggagaggcggaagtacgacggcgtagtattagtgtgcgngagatagattagacgtactacgtagagtaaggcgtaggtagtagtgtagtcgttg

SEQ ID NO: 372405 - DNA, 551 bp, Homo sapiens
  misc_feature: GZ8MTXP02FFNA3.15.67.G01.1.454.CMB.2.raw
  modified_base (274)..(274): a, c, t, g, unknown or other
  modified_base (312)..(312): a, c, t, g, unknown or other
  modified_base (390)..(390): a, c, t, g, unknown or other
  modified_base (411)..(411): a, c, t, g, unknown or other
  modified_base (430)..(430): a, c, t, g, unknown or other
  modified_base (438)..(438): a, c, t, g, unknown or other
  modified_base (452)..(452): a, c, t, g, unknown or other
  modified_base (454)..(454): a, c, t, g, unknown or other
  modified_base (457)..(457): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccggggggggtcccctgagactctcctgtgcagtctctggattnacccttagaagtattggatgacctgggtccgccaggcnccaggggaagggctggagtgggtggccaaacataaaacaaaaggacgaaagtcaagaaaaaacctatagtaggactcngtgaacgccgaatcaccatcnccagagacaaacgccaaanaattcacngtaatttgcaaaananaanacgcagagaggagagacgacgacgtgtatatgtgcgacgagagtagagtagtacgtactactacgaagtaagacgtaggtaggtagtagtagtg

SEQ ID NO: 372406 - DNA, 577 bp, Homo sapiens
  misc_feature: GZ8MTXP02ITQ9Y.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggcccgggggggtccctgagactctcctgtgcagtctctggattcacccttagaagttattggatgaccgtgggtccgccaggctccgaggggaaggggcgtgggaggtggggtggccaacataaaacaaagaacggaaagtacaagaaaaacctagtagtaggactctggtagacggccgattccaccatctccagacgacaacgcaaagaattcactgtattgacaatgaaacagcctagagaggacggaggacgacggcgtagtattagtgtgcgagagtagtgaagtaggtagactacgtaacgaaggttagacgtagggttggtacgttggtaagtttcgg

SEQ ID NO: 372407 - DNA, 560 bp, Homo sapiens
  misc_feature: GZ8MTXP02GB2TA.15.67.G01.1.454.CMB.2.raw
  modified_base (380)..(380): a, c, t, g, unknown or other
  modified_base (388)..(388): a, c, t, g, unknown or other
  modified_base (401)..(401): a, c, t, g, unknown or other
  modified_base (508)..(508): a, c, t, g, unknown or other
  modified_base (514)..(514): a, c, t, g, unknown or other
  modified_base (541)..(541): a, c, t, g, unknown or other
  modified_base (553)..(553): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttccttgttgttatttagaaggtgtccagtgtgaggtgcacttggtggagtcgtgggggaggctttggtccaggcccgggggggtccctggagactctcctgtgcagtctctggattcacccttagaagttatggatgacctgggtccgcagctcgaggggaaggggctggagtgggtggaccaaacaataaaacgaaagacggaagtcaaagaaaacctangtggactntgtagaccgcgtnttaccaccatctacagacacaaacgcccaaagacttacattagtatttagacaaatgaaacagcctagacgaggcgaggactacggcgtgtatttagtggtgaccgnggaagnttagactagtagacttcactaaggtanacgtaggtgtancgatttg

SEQ ID NO: 372408 - DNA, 556 bp, Homo sapiens
  misc_feature: GZ8MTXP02G9E1K.15.67.G01.1.454.CMB.2.raw
  modified_base (469)..(469): a, c, t, g, unknown or other
  modified_base (508)..(508): a, c, t, g, unknown or other
  modified_base (511)..(511): a, c, t, g, unknown or other
  modified_base (515)..(515): a, c, t, g, unknown or other
  modified_base (549)..(549): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtcccaggcccggggggggtccctgagactctcctgtgcagtctctggattcacccttagaagttattggatgaccgtgggtccgccaggctccgaggggaaggggctgggaggtgggtggccaacataaaacaaaggacggaaagtacgaagaaaaaccctatgtaggactcgtgtcgacgggccgaattcgacctatctccagacgacaacgccaaagattcactgtattgacaaatgaaanacgccgtgagacggcgagacgacgcgtgtatatgtgcgngangtanagtagtagactctacgaagtagacgaggtgtacngtagtcg

SEQ ID NO: 372409 - DNA, 684 bp, Homo sapiens
  misc_feature: GZ8MTXP02GP3SG.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagactctcctgtgcagtctctggacttcaccttagaagttatggatgacctggccgcaggctccgaggggagggcgtgggaggtgggtggacccaaacgaataaaacgaaaaggaacggaaagtaccgaaagaaaaaccctagtgtagggactcgtggtacgaccggggccgtaacgtttccaacccacttcctacccgaagaacgaacccgaaaccgacccgaaaagtaaacttacctaacgttacgttaagttttacggaacctaaaattacgaaaccgtacgacccgtagggaacgggacggggacggaacgggaccgaaccggggtacccgttagttaacttaggttcggtacggcgtacggagtagaacggtagtaagtacgtaacctacgtaacgtaagtagacggtagggtaggtaagtggtactttgg

SEQ ID NO: 372410 - DNA, 751 bp, Homo sapiens
  misc_feature: GZ8MTXP02G3KL3.15.67.G01.1.454.CMB.2.raw
  modified_base (612)..(612): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttggttttccttgttgttatttagaaggtgtccagtgtgaggtgcacgttggtggaggttcggtgggggaggtcgtttgggtcccgacgggtcccgggggggttcccctggaacggtaccttccttcccgtgtcgctacgttcctcgttggtactttccgtaacccctttaaggtaagtttagttagggaattcggaacccgttcggggtaccccgccggtaacggccgtaccggaagggggaacggggtcgtggggaaggttgggggtacggaaccccaaaacgaaacgtaaaaacgaaaggaaacgggtaaagaaccgaaaagtaaaaaacccttgtaggtacggacttcgtaggtaccggaccggggtccctacgttacccaccactccgtacaagaacgaccaaaccggacaaagtactttacacgttacgttaacgtttacgaactaaatcgaaacngaccgtagacgggagacggacggaccgaccgggtcgttacgttagttgttgtcggacgtacgtaggtagtagtaagtacgtacgtaactcgtaaacggtaagtaccggtcggtaaggggttagtacgtgtaacgtttgg

SEQ ID NO: 372411 - DNA, 808 bp, Homo sapiens
  misc_feature: GZ8MTXP02F0P62.15.67.G01.1.454.CMB.2.raw
  modified_base (336)..(336): a, c, t, g, unknown or other
  modified_base (368)..(368): a, c, t, g, unknown or other
tcagtctacgtagccacgaccggtgctcgatttagagtatacatattgggtttgaggtctcagagaggagccttagccctggactccaaggccctttccacttggtgatcagcactgagcacagagaactcaccatggagttggggctgagctgggttttccttgttgttattttagaaggtgtccagtgtggaggtgctacgttgggtggaggttcggtgggggaggtcgtttgggtaccgacggggcccgggggggttccctggagtacctcctccgtgtgctagtcctctggtacttcctacccttagaattatggatcgaccgtgggtcccnccgagccgtccggaggggacgggtcgtagggnggtggggtcggaccaaaacaaagtaaaaccgaaaagggtaacggaagtacgaaaagtaaaaacctagtagtacggacttcgtacggtacgggaaccggggtcccgtattaccgaaccctacttacccgtaccgaaagaaacgaaaccgaaacccgacccgtaaaagtaaactttccaccgttagttaatttacgactaaaactagaaaaccacggtacccgtaggggaacggaacgggaccggaaacggggaaccgtaaccgggggtacccgtttagggttaagtttaacgttcgggtttagggacccggtacggtaaagtaacggtaaggttaaaccgttaaaagggttaaccgtaaaccccgttagttaaaaccggtaagggttaaacgggaaccggtaagggggtttacggtttagtttaacggtaacggtttttgg

SEQ ID NO: 372412 - DNA, 617 bp, Homo sapiens
  misc_feature: GZ8MTXP02JPPNF.15.67.G01.1.454.CMB.2.raw
  modified_base (291)..(291): a, c, t, g, unknown or other
  modified_base (307)..(307): a, c, t, g, unknown or other
  modified_base (339)..(339): a, c, t, g, unknown or other
  modified_base (345)..(345): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccgaggcccggggggggtccctggagactctcctgtgcagtctctggattcacccttagagttnttggatgactggtccncaggctcgagggagggctggagtggtgccaanataaanaaagacggaagtcaaagaaaaaccctgtagtaggaactctaggttacggacggtccgtattccgaaccaattcccaccgaagacgaaccaaaccggcccaaaagacttacccgtatacgttaattttcgaaactaaagtagaaaaccgacgtacccgtagaggacgggtacggaaggtaccgaccggccgttagtatttaagttgcgccgaggtagatagaatacggtagacttacctaagaagacgtcgtaggtcgtataggtactttcgg

SEQ ID NO: 372413 - DNA, 792 bp, Homo sapiens
  misc_feature: GZ8MTXP02IODEL.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgtttattttagaaggtgtccagtgtgaggtgcacttggtggagtcgtgggggaggcttggtccgacgggcccggggggtccctgagacctctcctggtgcagtctctggattccacccttaagagttattggatgaccgtcgggtccgccgtaggcctaccgagggggaacgggtcgtggggaggtggggtacggaccgaaaacgaaagtaaaaccgaaaggtaaacgggaacgttaacaaaaggtaaaaaaccccttagtaggtacggtaccgtacgttcgggtacggaaccggggtcccgaactttacccgaaccctaccgttaccctaccgaaggaaaccgaaacccgaaaacccggaacccgtaaaaggtaaaccttaccgtaaccttaggttaatttacgaactaaaagtcgaaaacacggtacccgttagggaacgtacggggaaccgggaccggggtaaccgtaaccggggtccgtttaggtttaactttaagtttcggtacggccggttacgaggtaatcgggtaaaatacggttaacgtaaaccgttacgttaaaaccgaaggttaaacgtaccggttaaagggttgggttaacgtttacgggtactttttaagggg

SEQ ID NO: 372414 - DNA, 647 bp, Homo sapiens
  misc_feature: GZ8MTXP02GO9GI.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggaggtcgtgggggaggtcgtttggtccgagggcccgggggggtccctggagactctcctgtgcagtctcgtggtattccacccttagaagttattggatcgaccgtgggtcccgtccgaggcctccgaggggaaggggctgggaggtggggtggaccaaacaataaaacgaaagaacggaagtacaaagaaaaacctagtgtagactcgtgtacgacgccgattccacatctaccagaacgactaaaccgacaaagaacttcaacttgttaatttagaactaaaagtcgaaaacacgtacctaggaggaacgggacggaagggaaccacggggtaccgttaggtttattaagttggtgccggtaggaagataggaattacgggtaactaccttacgtaaccgaaggttagacgttaaggggttggtaaagtcggaagtttgg

SEQ ID NO: 372415 - DNA, 700 bp, Homo sapiens
  misc_feature: GZ8MTXP02IH8TS.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttatttagaggtgtccagtgtgaggtgcacttggtggagtcgtgggggaggcgttggtccgaggccggggggtcctggagactctcctggtgcagtctcgtggtactcctacccgttagtaagttagttggatcgaccgtcgggtccgccgaggcctcgaaggggaacggggcgtggggaggtcggggtacggaccaaacaaagtaaaaacgaaagggaaacggtaaagtacgaaaagaaaaaacctagttaggtacggtactcgttaggacgacccgggcgtacgttaccaaccctactacctaccgagaacgaaccgaaaccgtaccaaagtaaacttactacgttagttaacgttttcgaaacgtaaataacggaaaccgtacgtacccgtaggaagggaaggaccgggaacgggtaaccgaacggggtccgttaaggttagtttaagttcggtgacggtacggaagtagtacgtaaagtacgtacgtactaacgaccaagttacgacgtaggtaggtatagttacgttag

SEQ ID NO: 372416 - DNA, 741 bp, Homo sapiens
  misc_feature: GZ8MTXP02I1O1D.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccggggggtccctgagactctcctgtgcagtctctggattccacccttagattattggatgaccgtggtccgccacggcctccgaggggaagggctgggaggtggggtcgaccaaacaataaaacgaaagaacggaaagtacaaagaaaaaccgttagtgtagtacttctaggtacgaaccggggccctaacgtttaccaaccctagttacccgtacccgaaagaaacggaaaccaaaacccggaccccaaaagtaaactttccgaaacctttggttaacttttagaaacctaaaagttcgaaaaccgtggtaccctagggaaggtacgggaccgggaacgggtaacccgaaccgggtccggttagttaaaacgtttgtttacggtcgggtaccggacgggtaaaggttagtaccgggtaaagtttaaacgggtacgtaaacccgttacgtaaaccgtaacggttagacggttaaaggggttggtaacgttacggggttactttaaggg

SEQ ID NO: 372417 - DNA, 606 bp, Homo sapiens
  misc_feature: GZ8MTXP02JK8QB.15.67.G01.1.454.CMB.2.raw
  modified_base (307)..(307): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtcctggagactctcctgtgcagtctctggtacttccacccttagaagttatggatcgaccgtgggtccncgagctcgaggggagggctggagtggtgaccaaacaataaacgaaagaacggaagtacaaagaaaaacctgtagtaggactcgtggtacgaccggccgtaattaccgacctagtcctaccgaagacgaacaaccgtacaagaacttcattcgttattagacaaagttagaaacgacgtaccgtaggaaggacggaccggaagggtaccgaccgggacggtttagtaattagtcggtagcgtagagtatacgattacggtacacgtcaacgaagtagtacgtaggtgtatggatttacgg

SEQ ID NO: 372418 - DNA, 585 bp, Homo sapiens
  misc_feature: GZ8MTXP02I4632.15.67.G01.1.454.CMB.2.raw
  modified_base (344)..(344): a, c, t, g, unknown or other
  modified_base (388)..(388): a, c, t, g, unknown or other
  modified_base (397)..(397): a, c, t, g, unknown or other
  modified_base (416)..(416): a, c, t, g, unknown or other
  modified_base (436)..(436): a, c, t, g, unknown or other
  modified_base (521)..(521): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccagggcccggggggtccctgagactctcctgtgcagtctctggacttcctaccttagtaagttatggatgaccgtgggtccgccgaggcctccgaggggaagggctgggagtgggnggaccaaagaataaaacgaaagaacgaagtacaagaaaacctgngtagactgngtgacggcatcacctatcncagaacgacaaacgcaaaanactctactgttattgaacaaatagaacaacgctggaagacggaggagaccgcggtacgtgtaagttatggtacgcgacgaggtanggaaattacggtacaacttccgtaagaacgtacggacgtaggggttatacgtaggttatttcgg

SEQ ID NO: 372419 - DNA, 627 bp, Homo sapiens
  misc_feature: GZ8MTXP02JXCBE.15.67.G01.1.454.CMB.2.raw
  modified_base (316)..(316): a, c, t, g, unknown or other
  modified_base (397)..(397): a, c, t, g, unknown or other
  modified_base (428)..(428): a, c, t, g, unknown or other
  modified_base (473)..(473): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtggggggaggcttgggtccgagggcccggggggtccctggacgactctcctgtgcagtctcgtggacttccacccttagaagttatggatcgacctcgggtccnccgaggcctccgaggggaagggctgggagtggggtgaccaaacaactaaaacgaaaggacggaaagtcaaagaaaaccctntgtagactgtgtagaccgggccaattccacntcacagacgacaacgaccaaagtactacacttcgtatttacgaanaaagttcgaaacgacgcctagggagacgggcggaacggacgaccggtcgttagtacttaggttgtacggcgacgaggtatcggtaaagtaggtacgactttacgtaacgtaaggtaaccgcggtaacgggtaggttacgtggtaacttttaggg

SEQ ID NO: 372420 - DNA, 688 bp, Homo sapiens
  misc_feature: GZ8MTXP02FM0E0.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtggggggaggtcgttggtccgacgggccggggggtccctgacgactctcctgtgcgtagtcttcgtggtacttcctacccgttaagtaagtttagttgggatcggacccgtgggtcccgccgaggcctccggaaggggaaacggggtcgtagggagggttggggtcggaaccccaaaacaaacgtaaaaacgaaaacggaaaccgggaaagtaccgaaaagaaaaaacccgttagtaggtacggtactcgtagtacggaccggggccgattaccacctactctaccgaagacgaaacgaaccgacccaaagtaacttactactagttatttagactaaaatgaaacagccgtaggaggagggacggaaggaaccgcgggtaccgtggttaatttagttagtgacggagaagatagtaaataaggtacgaacgtcgtaacgtaagacggtacgtagggtggttaacgtggtacgtttag

SEQ ID NO: 372421 - DNA, 646 bp, Homo sapiens
  misc_feature: GZ8MTXP02HVY34.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggcttggtccgagggccgggggggtccctggacgactctcctgtcgcagtctctggattcacccttagaagttattggatcgacctggtccgccaggcctccgaggggaaggggcgtggacggtggggtacggacccaaactaaagtaaaaccgaaaaggaacgggaaagtacaaagtaaaaaccctagtagtacggaacttcgtagtaggaccgggccgtattaccgaaccctaagtcctaccaagacgaaacaacgacccaaagaacttacaacgttgttatttcgaactaaatacgaaactacgacctaggagacgggacggaacggaccgacgggccgttagtatttacgtgtggaccgtggaaggtataggagttacgacgtactaccgtagaagtacgagtaggtagtagtcgtatttcg

SEQ ID NO: 372422 - DNA, 640 bp, Homo sapiens
  misc_feature: GZ8MTXP02I43DM.15.67.G01.1.454.CMB.2.raw
  modified_base (380)..(380): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggccggggggtccctgagactctcctgtgcagtctctggattcaccttagattatggatgaccgtggtccgccaggctccgaggggagggctgggaggtgggtggaccaaacaagtaaaacaaaggaacggaatcgaaagaaaaacctntaggtcgaactctagacgacgggccgtattccgaccatctacagagtacaacgacaaagacttcaacttgtaatttgaaactaaagtacgaaacacgtacctagggaagaacgggtacggaaggaaccgtaccgggtacccgttagttaacgtttaagtttgggtacggtacggacggaagtagtaccgtaaagtaaccgtttaaagaccttccgtaacgaaggtacgacggtaggggtggttaacctggtaacctttgg

SEQ ID NO: 372423 - DNA, 582 bp, Homo sapiens
  misc_feature: GZ8MTXP02FIV4X.15.67.G01.1.454.CMB.2.raw
  modified_base (578)..(578): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctcgtggattcacccttagaagttattggatgacctggtccgccaggctccgaggggaaggggctgggaggtggggtcggacccaaacaataaaacgaaaagacggaaagtacaaagaaaaacctatgtaggactctggtaggaccggccgattccaccatcaccgagacgacaaacgaccaaagaacttcactgtatttagactaaaatcgaaacgagacctaggacggaagggcggaaggaccgacggccgtgtattagttgtgcgtacggagatagatagtacgactctaacaagtagcgaggtgtagtgtnttag

SEQ ID NO: 372424 - DNA, 635 bp, Homo sapiens
  misc_feature: GZ8MTXP02FIB6F.15.67.G01.1.454.CMB.2.raw
  modified_base (203)..(203): a, c, t, g, unknown or other
  modified_base (341)..(341): a, c, t, g, unknown or other
  modified_base (359)..(359): a, c, t, g, unknown or other
  modified_base (499)..(499): a, c, t, g, unknown or other
  modified_base (507)..(507): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttccttgttgttattttagaaggtgtccagtgtgaggtgcacttggnggagtcgtgggggagcttgggtccaggccgggggggtccctgagactctcctgtgctagtctcgtagtacttctaacctagtaagttagttggatcgaccgtcggtcccgcgagccgtacggaggggacgggcgtggnggtgggtcggaaccaaanaataaaacgaaacggacggaatacgaaaagaaaacctgtagacgtacgtcgttagacggaccggccacttaccacctattacgaccgaagaacgaacgaaacccgtaacaaagtactaccgtagtattattacgataaanagaaaccncgcgtaggacgacggacgtacgaccgtacggtacgttagttattagtcgtagacggtagtagacgtagacgttaacgtacgtactacgtaacgaaggtacggtaggtacggtagtagtcgtagtttcg

SEQ ID NO: 372425 - DNA, 623 bp, Homo sapiens
  misc_feature: GZ8MTXP02IWLV9.15.67.G01.1.454.CMB.2.raw
  modified_base (258)..(258): a, c, t, g, unknown or other
  modified_base (260)..(260): a, c, t, g, unknown or other
  modified_base (303)..(303): a, c, t, g, unknown or other
  modified_base (364)..(364): a, c, t, g, unknown or other
  modified_base (414)..(414): a, c, t, g, unknown or other
  modified_base (419)..(419): a, c, t, g, unknown or other
  modified_base (474)..(474): a, c, t, g, unknown or other
  modified_base (528)..(528): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggagcttggtccaggcccggggggtccctgagactctctgtncngtctctggattcaccttagaagttatggatcgaccgtgggccncctaggctcgaggggagggctggaggtgggtgaccaaacataaaacaaaggacggaagtanaagaaaaacctgtgtaggacttcgtaggtacgacgggcctattccaaccntaccnccagacgaacaacgacctaaagaacttcattgttactttagaacaaatacgaaanacgtcagaggaggcgaaggaaccgccgggtagttggttaaattgtttacggggngtacgggacgtaaggtagttacggtaagttaacggtacgtaacttacgtaacgtaaggtacgtacggtacgggttaggtacgtcggtagtttcgg

SEQ ID NO: 372426 - DNA, 572 bp, Homo sapiens
  misc_feature: GZ8MTXP02GZUR3.15.67.G01.1.454.CMB.2.raw
  modified_base (418)..(418): a, c, t, g, unknown or other
  modified_base (446)..(446): a, c, t, g, unknown or other
  modified_base (451)..(451): a, c, t, g, unknown or other
  modified_base (456)..(456): a, c, t, g, unknown or other
  modified_base (466)..(466): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggcccgggggggtccctggagactctcctgtgcagtctcgtggattccacccttagaagtttattggatgaccgtgggtccgccaggcctccgaggggaaggggctgggagtgggtgaccaacataaacgaaagacggaagtacaaagaaaaacctatgtagactcgtgtacgacggccattccaccntcctacagacacaacgacaagaatcatntattnacaanacgaaacganccgtgaggagggacggaggaccgacggccgtagtacttagtgtgccggagagtatagagtaggtacacgtactactaagtacgacgtaaggtgtaatcggtagttg

SEQ ID NO: 372427 - DNA, 576 bp, Homo sapiens
  misc_feature: GZ8MTXP02H0C06.15.67.G01.1.454.CMB.2.raw
  modified_base (265)..(265): a, c, t, g, unknown or other
  modified_base (299)..(299): a, c, t, g, unknown or other
  modified_base (407)..(407): a, c, t, g, unknown or other
  modified_base (416)..(416): a, c, t, g, unknown or other
tcagtctacgtagccacgaccggtgctcgatttagagtatacatattgggtttgaggtctcagagaggagcccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggccgggggggtccctgagactctcctgtgcagtcnctggattcaccttagagttatgatgactggtccncaggctccgagggagggctggagtgggtggaccaaacaataaaacaaagaaccggaaagtacaaagaaaaacctatgtaggactctgtagacggcgattacaccatcnccagacganaacgcaaagaactcactgtattagacaaatagaaactagcctagagaggacgaggacacggaccgttgtattatgtacgcgacgagatagtaagtaacgttagaacttaccgtaacgaaaggtaggtaacgtacggggtaggtacttagggtaactttgg

SEQ ID NO: 372428 - DNA, 858 bp, Homo sapiens
  misc_feature: GZ8MTXP02HPZ4Q.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgtttattttagaaggtgtccagtgtgaggtgctacgttgggtggaggttcggtgggggaggtcgttgggtcccgacggggccccggggggggttccctggaacggtaccttccgttccgttggtgcctagtccttcgtggtacttacctacccgttaagtaaggtttagttgggagtcgtaccgtcggggtccccgaccgaggccgtacccggaagggggaacggggcgttggggaggttggggtacggaacccaaaacgtaaaacgtaaaaacgaaaaggaaacgggtaaaacgtaacgaaaaacggtaaaaaaacccttagtacgggtacggtaaccttcgttaacgggtaacgggtaacccggggtcccgtaaactttcccgaaacccctaagtaccccgtacccgaaacggaaacgaaacccgaaaacccggaacccgtaaaaggtaaactttaccgaaacgtttaggtttaaacgttttacggaaactaaaaagttaccggaaaactaacggtaccgtaggaagggaacgggaccgggaaacgggacccgaaccggggtccgttaaggttagtttacgttagggcgtcggacgtaaggtagttaggtaaataaagggttacgaaccgttacctaaaggtaacggttagacgggttaaagggttgttaagtcggtttaagtttacgg

SEQ ID NO: 372429 - DNA, 654 bp, Homo sapiens
  misc_feature: GZ8MTXP02IY2T7.15.67.G01.1.454.CMB.2.raw
  modified_base (592)..(592): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcggtgggggaggcgttcgggtccgacgggcccggggggggttcccctggacggaccttccttcccgtggtcgcagttctcgtgggattccaccccttagaacgttattggatgacctgggcccgccgaggcctccgagggggtaaggggcgtgggaggtggggtcggacccaaaacataaaacgaaaggaacggaagtacaaagaaaaaccctgtagtaggacttcgtagtcgaaccggggccgtaatttaccacctatacctacccgaagaaacgaaccaaaccgacccaaaagtaacttaccgaacttgttaacttttgacaaaatgaaacagcctaggagagggcggaacggaccgacgggtaccgtgtaattagttgngccggcgagataggataggtacgacgtctaacgaagtacgtcgaggtggtactgtatttcgg

SEQ ID NO: 372430 - DNA, 554 bp, Homo sapiens
  misc_feature: GZ8MTXP02JOMUU.15.67.G01.1.454.CMB.2.raw
  modified_base (297)..(297): a, c, t, g, unknown or other
  modified_base (304)..(304): a, c, t, g, unknown or other
  modified_base (332)..(332): a, c, t, g, unknown or other
  modified_base (416)..(416): a, c, t, g, unknown or other
  modified_base (464)..(464): a, c, t, g, unknown or other
  modified_base (503)..(503): a, c, t, g, unknown or other
  modified_base (508)..(508): a, c, t, g, unknown or other
  modified_base (529)..(529): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttttagaaggtgtccagtgtgagggtgcacttggtggagtcgtgggggaggcttggtccagccggggggggtccctgagactctcctgtgcagtctctggatcacccttagagttatggatgaccngggtccnccaggctccaggggaggggctggggagngggtggccaacaataaacgaaaaggacggaagtacagaaaaaaccctgtagtgactcgtagtcgacgggccgattccaccatcnccgaagacgacaaacgccaagatacactgtatttacgcaaaatgaaanagacctgaggaggcgaggactacggccgtgtatatggtnccggngagatgatacgtacgactcanaagagacgaggtagtagtagtagtg

SEQ ID NO: 372431 - DNA, 667 bp, Homo sapiens
  misc_feature: GZ8MTXP02J1KI5.15.67.G01.1.454.CMB.2.raw
  modified_base (299)..(299): a, c, t, g, unknown or other
  modified_base (360)..(360): a, c, t, g, unknown or other
  modified_base (433)..(433): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggtcttgggccgagggcccgggggggtccctggagactctcctgtgcagttctcgtggtacttccacccttagaagttntggatcgaccgtgggtcccgcctaggcctcgaggggagggctgggaggtggggcgaccaanaactaaacgaaagacggaatacgaaagaaaaccctgtgtacgacttctaggtacgaccggcctagtccaccgntccacgagtaacgaacccaccgactaaacgattacacgtttcggttaatttacggaacctaaagtcgaaacgtcgacccgtaggaacggtacgggaccggaacgggaaccaccggggtacccgttaggttaattacgtggtcgacgtcggagtagtagaacgttaacggtacgaaccgttcgtaaacgtaacggtacgtacggtacggggttagtacgttacggtacttttcgg

SEQ ID NO: 372432 - DNA, 611 bp, Homo sapiens
  misc_feature: GZ8MTXP02GBBIN.15.67.G01.1.454.CMB.2.raw
  modified_base (303)..(303): a, c, t, g, unknown or other
  modified_base (365)..(365): a, c, t, g, unknown or other
  modified_base (490)..(490): a, c, t, g, unknown or other
  modified_base (587)..(587): a, c, t, g, unknown or other
  modified_base (600)..(600): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggagtcggtgggggaggtcttcgggtccgacgggtcccgggggggtccctggacgactcctccgtgtcgctagtctctggacttcaccgttagaagttnttggatcgaccgtgggtccgccgaggcctcgaggggagggctggaggtggggtcgaccaaanaagtaaaacgaaaggacgaagtacaaaggaaaaacctgtagtgactctaggtacgaccgggcagttaccacactcacagaacgaactaacgaccaagtaactcaactgtaacttgactaaaagtnaaacgacgtcgagagacggtaacggacgaaccgacggtcgtagtttactagttgacgcgacgagtatcgtaatacggtagtaccctgtagaaggtanagtaggtaggtangtagtttccgg

SEQ ID NO: 372433 - DNA, 672 bp, Homo sapiens
  misc_feature: GZ8MTXP02FZ55G.15.67.G01.1.454.CMB.2.raw
  modified_base (266)..(266): a, c, t, g, unknown or other
  modified_base (668)..(668): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgttggtggagtcgtgggggaggcttggtccgagggccggggggtccctgagctctcctgtgcagtctntggattcaccttagtaagttattggatgaccgtgggtccgccgaggcctaccgaggggaacggggcgtagggtaggtggggtcgggacccaaaacgaaacgtaaaacgaaaacggacgggaaacgtaccaaaagaaaaaacccttagtagtagggaccttacgtaggtacggaaccggggcccgaaatttaccaaacccattaccacccaaaggaacgaaaccaaaccgaacccaaaagtaaacttactaacgttgtttaatttacggaactaaaagtacgaaaacaacggaccttaaggaacggagggacgggaacggaaccgacgggtaccgttagtaatttagtagtgccggagagagtgaaatagtacgactagacaagtgacgtaggtgtactagtnttag

SEQ ID NO: 372434 - DNA, 597 bp, Homo sapiens
  misc_feature: GZ8MTXP02HM210.15.67.G01.1.454.CMB.2.raw
  modified_base (475)..(475): a, c, t, g, unknown or other
  modified_base (477)..(477): a, c, t, g, unknown or other
  modified_base (480)..(480): a, c, t, g, unknown or other
  modified_base (484)..(484): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtggagtcgtgggggaggcttggtccgaggcccgggggggtccctgagactctcctgtgcagtctctggacttcacccttagaagttatggatgaccgtgggtccgcaggatccgaggggaagggctggaggtgggtcggaccaaacgaaataaacgaaaagacggaaagtacaaagaaaaacctagtagtaggaactctaggtagaaccggcgtacttccacctaattcaccgaagaacgtaacaacggaccaaagaactctactgttattananaanaganagacgagagaggacgagacgacgacgtagtatagtgtgacgacgagtagtagtaagtaacgtacgtacgtaacgtaagtaagtacgtacggtacggtaggtacgtagtagtag

SEQ ID NO: 372435 - DNA, 760 bp, Homo sapiens
  misc_feature: GZ8MTXP02GFSBA.15.67.G01.1.454.CMB.2.raw
tcagtctacgtagccacgaccggtgctcgatttagagtatacatattgggtttgaggtctcagagaggagccttagccctggactccaaggccctttccacttggtgatcagcactgagcacagaggactcaccatggaggttggggctgagtcgttgggttttccttgttgtttatttagaaggtgtccagtgtggaggtgcacgtttggtggagtcggtgggggaggtcgttggtccgacggggcccggggggtccctggacgacctctccgtgtgcagttctcgtggtattcccaaccccgttaagtaaagttagtttgggatcgaccgtcggggtcccgccgaggcctacccgaaggggaacggggctgggaggtggggtcggaccaaaacgaataaaacgaaaaggacggaaagtacaaaagaaaaacctagtagtaggacttcgtagtacggaccggccgaacttaccacctacttcccgaccgaagaacgaaacccgaaaccggtaacccaaaagtaactttacccaaacgttggttaaactttagaacctaaaaagtacgaaaaccagtccgaagggaggaacggggacgaacgggtaaacccgacggggtacccgttaggttaaacgttagttgggtacggccggtacggaagtaagttacgaaagtttaacccgggtaagtaaccctaccgtaaaacgtaagggttagtaaccggtaaggggttaggttaacgtaccggtaagttttcgg

SEQ ID NO: 372436 - DNA, 631 bp, Homo sapiens
  misc_feature: GZ8MTXP02HV6DE.15.67.G01.1.454.CMB.2.raw
  modified_base (578)..(578): a, c, t, g, unknown or other
  modified_base (623)..(623): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggaggttcgtggggggaggcgttgggtccgagggcccgggggggtccctggagactctcctgtgcagtctctggattcacccttagaagttattggatgacctgggtccgccaggctccgaggggagggacgtgggaggtggggtcggaccaaacgaataaaaaccgaaaggaacgggaaagtcaaaagaaaaacccgtagttaggtacggacttcgtaggtacgaccggggcctaattccacctatcgtacagacgacaacgacaaagattctactgttattagactaatagaaacagccgtagaaggagggacgggaacggtaacgacggggtacgttaggttaatttagttggtacggcggacgtaaggntagaagttaagtacgacttactagaaggttagcgtaaggtgtacngttacgtg

SEQ ID NO: 372437 - DNA, 940 bp, Homo sapiens
  misc_feature: GZ8MTXP02G0AT3.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgctacttggtggagtcggtgggggagtcgttggtccgagggccggggggtcctgagactctctgtgcagtctcgtgacttccaccttagaagttagttggatcgaccgtcgggtccgccgaggtccgtccggaagggggaaggggtcgtaggggtaggttcggggtacggtacccaaaacgtaaacgttaaaaaaccgaaacgggtaaaccgggaaaggtaaccgtaaaaaaggtaaaaaaacccgtttagttacgggttaacggtaaccgtttacggttaacggggttaacgggaaacccgggggtcccctaaacggttttacccccaaaacccttaaccgtttaccccgtaaccccgaaagggtaaacccgaaaacccgtaaaaccccggtaaccccgaaaaaaggttaaacctttaaccccggtaaaacccgtttaacggtttaaatttttaaccggaaaccttaaaaaagttacggaaaaacccgtacgggtaacccgttaagggtaaaaggggaccgggtaaaccgggggaaacgggtaaaccccggtacccggggttaaccggtttaacggtttaagtttaaccgggtttggtaacgggtccgggtaaacgtacggtaaaaggttccggttaaaaggtacggtttaaccgtaaacccgtttcgaaaaccggttaacggtttaacggaacggtttaaacgggggttaggtttaaccggtttaacggtacgtttttacgggg

SEQ ID NO: 372438 - DNA, 592 bp, Homo sapiens
  misc_feature: GZ8MTXP02GDIDN.15.67.G01.1.454.CMB.2.raw
  modified_base (487)..(487): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccaggccgggggggtccctggagactctcctgtgcagtctctggattcaccctagaagttattggatgacctgggtccgccaggctccgaggggaaggggctggaggtggggtggaccaaacgataaaacgaaagaacggaagtacaaagaaaaaaccctagtagtaggactcgtgtagaaccgggccgattcaacccattacacccaagagaacaaaccgccaaagaaacttcaactgtatttaggcaaaatgaaaacnggaccagaggaggacgagaccgaacggtccgtagtattatgtagccgacgagagtgaagttagtaccgatccgtaacaagttacgcgtaggtgtaatggtatttg

SEQ ID NO: 372439 - DNA, 597 bp, Homo sapiens
  misc_feature: GZ8MTXP02JOIEY.15.67.G01.1.454.CMB.2.raw
  modified_base (512)..(512): a, c, t, g, unknown or other
  modified_base (534)..(534): a, c, t, g, unknown or other
  modified_base (589)..(589): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtccctggagactctcctgtgcagtctctggatcaccttagaagttattggatgaccgtgggtccgccaggctccgaggggaaggggcgtgggaggtgggtcggaccaaacgaagtaaaaccgaaagaacgggaagtacaaagaaaaaacctgtagtacggaactcgtagtagacccggtcgtaaattccaccattcctacagtagacaaccgaccaagattaccatagtatttacataaatagaacagaccgtagagacggacgaggaacccgnggtaccgtgttagtatttcggngacggtcgagtatgaaggtagttacgactaccgtagaagttgacgtaggtgtaangacgtttg

SEQ ID NO: 372440 - DNA, 531 bp, Homo sapiens
  misc_feature: GZ8MTXP02FSVCL.15.67.G01.1.454.CMB.2.raw
  modified_base (285)..(285): a, c, t, g, unknown or other
  modified_base (296)..(296): a, c, t, g, unknown or other
  modified_base (314)..(314): a, c, t, g, unknown or other
  modified_base (323)..(323): a, c, t, g, unknown or other
  modified_base (367)..(367): a, c, t, g, unknown or other
  modified_base (424)..(424): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctggtttccttgttgttattttagaaggtgtccagtgtgaggtgcacttgtggagtctgggggaggcttggtccaggccggggggggtccctgagactctcctgtgcagtctctggattcacccttagatatggangacctggtccncagctccagggaagggcnggagtgggngaccaaacataaaacaaagacggaatcaagaaaaaacctgtagnggactctgtgacggccgattcaccatcgtccagagaacaaacgcccaaagattcacngttaattgacaaaatgaaacagcctgagagggacgaggaccacgggccgtagtatagtgtgcgcgagatgataagagactcgtacaagtagcaggtgtaatcgatcg

SEQ ID NO: 372441 - DNA, 717 bp, Homo sapiens
  misc_feature: GZ8MTXP02ITZXZ.15.67.G01.1.454.CMB.2.raw
tcagtctacgtagccacgaccggtgctcgatttagagtatacatattgggtttgaggtctcagagaggagccttagccctggactccaaggccctttccacttggtgatcagcactgagcacagaggactcaccatggagttggggctgagctgggttttccttgttgttattttagaaggtgtccagtgtgaggtgcacttggtggagtcgtgggggaggtcgttggtccgaggccgggggggtccctggagactctcctgtgcagtctctggatcacccttagaagttatggatgacctgggtccgccaggctccgaggggaagggctggagtggggtgaccaaacataaaaacgaaagacggaagtacaaagaaaaaacctagtgtaggaactcgtaggtagaccgggccgtaacttccgaacctacgttactacccaagaaacgaaaccaaaccgaacccaaaaggtaaactttaccaactttacggtaaattttgaacctaaaagttagaaaaccgcgtaccgttaggaagggacgggacgggaaacgggaaacccgaaccgggttcccggttaaggtttaacgtttaagttcggttacggccggtaccgggaagtaaagtttacggaaagttaaggtaacggtaaccttacctaaccgtaaaggttacggacggtaaacgggtaggtttaaacgttcggtaaacgtttcgg

SEQ ID NO: 372442 - DNA, 598 bp, Homo sapiens
  misc_feature: GZ8MTXP02GFE97.15.67.G01.1.454.CMB.2.raw
  modified_base (525)..(525): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtccgccaggctcgaggggacgggctggaggtgggtggaccaaacataaaacgaaagacggaaatacaaagaaaaacctagtgtaggactctgtaggaccgggccaattccacctatctaccgaagagaccaaaccgacccaaagaacttcactagttaatttagactaaaatgaaaccagacctaggagacgggacggaggaccgacggccgttagtacttatgngcgacgagtatagaataggtactaacgttactaacgaaggttacgacggtagggttagtagtacgtagtttgg

SEQ ID NO: 372443 - DNA, 739 bp, Homo sapiens
  misc_feature: GZ8MTXP02GVQPW.15.67.G01.1.454.CMB.2.raw
  modified_base (618)..(618): a, c, t, g, unknown or other
  modified_base (692)..(692): a, c, t, g, unknown or other
  modified_base (714)..(714): a, c, t, g, unknown or other
  modified_base (721)..(721): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgctacgttggtggtagtcggtgggggaggtcgttcgggtccgacggggtccccgggggggttccctaggacgtaccttccgttccgtggtcgctacgttctcgtggtacttcctaaccgttaagtaagtttagttgggattacggaccgttcggggtcccgccgaggccctccggaagggggacgggcgtagggaggtggggtacgaccaaacgtaaagtaaaacgaaacggaacggaaacgtacgaaaaagtaaaaacccgttgtacggtacggtaccttacggttacggtaacgggaccggggtccttaaacttcccaaaccgtacttaccgtaaccgaaggtaaaccgaaacctaaaacccggataaaacggtactttacccgatttaaggtttacttagaaacctaaaagtcgaaaacncgtacgaggaagggacgggacggaaacggaccgtacggtacgttgttaaacgttgttcggagccgtagaaagtntagtactaggtactctacgtanaaggtancggtagtgactggatttg

SEQ ID NO: 372444 - DNA, 585 bp, Homo sapiens
  misc_feature: GZ8MTXP02IIHTN.15.67.G01.1.454.CMB.2.raw
  modified_base (309)..(309): a, c, t, g, unknown or other
  modified_base (330)..(330): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggaggcttggtccgacgggccggggggtccctggagactctcctgtgcagtctcgtggattcaccctagaagttatggatgacctgggtccncaggctccgaggggaagggcnggaggtgggtcggaccaaacaataaaacgaaagacggaaagtaccgaaagaaaaaaccctgtaggtggaactcgtaggtacgaccggccgtaattaccaccaagttcacccagaacgaaccaaacgacccaaagtaattacgactgtatttgactaaatcgaaacagcctagagacggcgaggacacggcgtgtattagttcgtgcgacgagatgaactagacgactacataagacgcgtaggtgtatgattcgg

SEQ ID NO: 372445 - DNA, 631 bp, Homo sapiens
  misc_feature: GZ8MTXP02I4RVZ.15.67.G01.1.454.CMB.2.raw
  modified_base (573)..(573): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccgaggcccggggggtccctgagactctcctgtgcagtctcgtggattcacccttagaagttattggatgaccgtcgggtccgccaggctccgaggggaaggggcgtgggaggttggggtcggaccaaaacaataaaacgaaaaggaacggaaagtacgaaaagaaaaaaccctagtaggtacggacttccgtaggtacgaaccggggcccgtaacttccaacccatcctaccagaacgacaaaccgaccaaagaacgttacactgttatttagacaaatgaaacacgtcctaggagacgggacggaacggacgacggacgtagttaattagttgtagcgacgganagtagaattacggtaacgtactctaacgaaggttagcgtaggtagtagtagtagtttg

SEQ ID NO: 372446 - DNA, 727 bp, Homo sapiens
  misc_feature: GZ8MTXP02GR6P1.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgctacttggtggagtcgtgggggaggcttggtccagggccggggggtcctggagactctcctgtagctagtctctaggtacttccaccgttagtaagttagttcggatcgaccgtcgggtccgccgacggtctaccggaagggggaacgggtcgtggggtaaggtggggtacggacctaaaacaagtaaaacgaaaaggacggaaatacgaaaagaaaaccctgtagtgtaactcgttacggagacccggggctaattaccaccctaattccgaccaagacgtaaccaaaacggtcctaaaagtacttcccatttacggtaatttacggaaactaaaagttcggaaaaccagtaccggtaggaaggtacgggacggaaacgggaccgttacgggtacgttaagttacgtttagtcgggtacggacggtacggtaggtaaggtacggtaagttaacggttaacgttaaccgttaacgttaacgtaacggtaacggtaacggtacgggttacggtacggttacggttacgttacg

SEQ ID NO: 372447 - DNA, 601 bp, Homo sapiens
  misc_feature: GZ8MTXP02F5XZ8.15.67.G01.1.454.CMB.2.raw
  modified_base (310)..(310): a, c, t, g, unknown or other
  modified_base (329)..(329): a, c, t, g, unknown or other
  modified_base (391)..(391): a, c, t, g, unknown or other
  modified_base (476)..(476): a, c, t, g, unknown or other
tcagtctacgtagccacgaccggtgctcgatttagagtatacatattggggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcattggtggagtcgtggggggaggcttgggtccaggccgggggggtccctggacgactctcctgtgcagtctctggtattcacccttagaagttattggatgacctgggtccncaggctcgaggggagggcnggaggtggtcgccaaacgataaaacgaaagacggaagtcaaagaaaaccctgtagtggactntaggtagaccgggctattcacctatctaccaagagacaaccgaccaaagacttacactagttatttagactaaagacgaaactancctaggacgaaggacggaaggaccgacgggacgtggttattagtcgtggccgaggagattaggaacttacgtagtaacgtccttaagaagttagaccgtaaggggttgttaagacgtagtttagg

SEQ ID NO: 372448 - DNA, 612 bp, Homo sapiens
  misc_feature: GZ8MTXP02ICGP9.15.67.G01.1.454.CMB.2.raw
  modified_base (305)..(305): a, c, t, g, unknown or other
  modified_base (474)..(474): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattccaccttagaagttatggatgacctgggtccnccaggcctccgaggggagggcgtggaggtgggtgaccaacaagtaaaacgaaagacggaatacgaaagaaaaacctgtagtaggactgtggtacgaccggcgtatccacctactcctacagacgacaacgacaaagtacttcacttgtatttgaaactaatagaaaacngtacctagggaaagacgggacggaggaccgacggtacggttagttagtttagtcgtgaccgtgaaggtatacgtaagtaagttaacgccgtttaaactacgtaaggtagacgtagggttaggtattaggtactttagg

SEQ ID NO: 372449 - DNA, 734 bp, Homo sapiens
  misc_feature: GZ8MTXP02GVT1D.15.67.G01.1.454.CMB.2.raw
tcagtctacgtagccacgaccggtgctcgatttagagtatacatattgggtttggaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttattggatgaccgtgggtccgcaggctccgaggggaggggctgggacgtggggtcggaccaaacaataaaacgaaaggacggaaagtacaaaggaaaaaaccctgtagtaggaacttcgtaggtacgaaccggggccgtaacttccaaccctaattccacccgaaaggaacgaacccaaaaccggccctaaaaggaacttcgaacttaggttaatttacggaactaaaattacgaaaacgacggttaccctagggaacgaaggggaccggaacgggaaccgttaaccggggtcccggtttagggttaaactttagtttacgggggcggtaccgggtacggtaacggtagttaacggaaacggttaaccggtaacgtaaccgttaccgtaaacggtaacggtaacggtacgggttaacgggttacggttaacgttacggtaccgtttgg

SEQ ID NO: 372450 - DNA, 639 bp, Homo sapiens
  misc_feature: GZ8MTXP02GXTG9.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcgttgggttttccttgttgtttattttagaaggtgtccagtgtgaggtgcacgttggtggagtcggtgggggaggtcgttgggtccgagggcccggggggtccctggacgaccttcctccgtgtgctagtctcgtggacttccacccttaagtaagtttattggatgaccgtgggcccgccgaggcctccgaggggaaggggctgggacggtggggtcgaccaaacaataaaacgaaagacggaagacaaaggaaaaacctgtagtaggactcgtggtacggaccggccgattaccacctatcctaccagacgaccaaaccgacaaagaatacacttagtatttagacaaagttacgaaactagtaccgtaggaagacgggacggaggaccgtacggcgttagtaatttagtcggtgcgacgagtaggtgaagttacgtaacgtactacgtacgtaaggtacgacggtaggtgttagtcgtaacgtttgg

SEQ ID NO: 372451 - DNA, 624 bp, Homo sapiens
  misc_feature: GZ8MTXP02JYFVQ.15.67.G01.1.454.CMB.2.raw
  modified_base (265)..(265): a, c, t, g, unknown or other
  modified_base (407)..(407): a, c, t, g, unknown or other
  modified_base (549)..(549): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttgggtccgaggcccgggggggtccctgagactctcctgtgcngtctcgtggacttccaccgttagaagttatggatcgaccgtgggtcccgccgaggtcctccgaggggacgggcgtgggaggtgggtggaccaacaaataaacgaaaggacggaagacaaaagaaaaccctgtgtagactcgngtacggaccgccgtattacccactactctaccgaagacgaaacaacgacgaaacgtaactccactgtaactttgaactaatagaacagtccgtaggagagggcggtaaggacccgacgggtccgttagtaatttgtttcggngacggagtagtagagtagtacgtaacgtacgtagtaacgtaaggtacgtaggtaggttaggcgtagtacgtttcg

SEQ ID NO: 372452 - DNA, 668 bp, Homo sapiens
  misc_feature: GZ8MTXP02HXVRX.15.67.G01.1.454.CMB.2.raw
  modified_base (316)..(316): a, c, t, g, unknown or other
  modified_base (355)..(355): a, c, t, g, unknown or other
  modified_base (515)..(515): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggagtcgtgggggagtcgttggtccgagggccgggggggtcctggacgtactctcctgtgcagtctcgtggattcctaccttagaagttattggatcgacgtgggtcccnccaggctccgaggggagggctgggaggtgggtcgacaanaataaaacaaagacgaaagtcaaaagaaaacctagtgaggtacttcgtggtacggaccggccgtatttaccaaccctagtaccctacgagaacgaaccaaaccggaccctaaagtaactttacacttaggttaatttaaggacctaaaagtcgaaaaccncgtaccgtagggaaaccgggagggaaccgaggggaaaccgacggggtaccgttagtaagtttatggtacgccgggtacaaaggtgtagaccgttaaagtacgaccttacttaacgaaggttacgacggtaaacggggtttgtagtagtacgtg

SEQ ID NO: 372453 - DNA, 692 bp, Homo sapiens
  misc_feature: GZ8MTXP02I18QJ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggagtctggggggaggtcttggtccgaggccgggggggtccctggagactctcctgtgcagtctcgtggattcacccttagaagttattggatgaccgtgggtccgccacggcgtccgagggggtaagggcgttgggaggtggggtcggaccaaaacgaataaaaacgaaacggaacgggtaaacgtaacgtaaacgaaaaaaccctgtacggtacgggtaaccttccgtaggttacggaacggggtcccgtaattacccacctaatcctacccaaggaaacgaaccgaaaaccggaacccaaaggttaattaccgaaacttggttaactttaagaacctaaattagaaaaccgcgtacgaggacggacgggacggtaacggacgacggttacgttagttacgtttagtcgtacggacggtagagagtagtagtacgtacgtacgtacgtacgtaaggtaggacggtaggtaggtagtagtagtacg

SEQ ID NO: 372454 - DNA, 599 bp, Homo sapiens
  misc_feature: GZ8MTXP02J17Y6.15.67.G01.1.454.CMB.2.raw
  modified_base (197)..(197): a, c, t, g, unknown or other
  modified_base (311)..(311): a, c, t, g, unknown or other
  modified_base (406)..(406): a, c, t, g, unknown or other
  modified_base (491)..(491): a, c, t, g, unknown or other
  modified_base (502)..(502): a, c, t, g, unknown or other
  modified_base (528)..(528): a, c, t, g, unknown or other
  modified_base (547)..(547): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgnacttggtggagtcgtgggggaggcttggtccaggccgggggggtccctggagactctcctgtgcagtctctggattccacccgttagaagttattgggatgaccgtgggtcccncgaggctcgaggggtaaggggcgtggaggtgggtcgccaacaataaaacgaaacggaacggaagtacaaagaaaaaccctagtgtacggactcgngtacgaccgcgtaactcgaccatcgtacacgaagaaccaaacggcccaaagtaacttcgacttgtatttagaactaatacgaaanagccgtagagnggacggaggacgtacgggcgtaggtnttagttggagcgacgaganagacgttagtacactactacgaagtacgcgaaggttggtatggtaatttcgg

SEQ ID NO: 372455 - DNA, 617 bp, Homo sapiens
  misc_feature: GZ8MTXP02IR11Y.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgtttattttagaaggtgtccagtgtgaggtgcacttgggtggagtcggtgggggaggcgttgggtcccgagggccccgggggggtccctggagacctctcctgtgctagtctctggattcacccttagaagttattggatgacctcgggtccgccgaggcctccgaggggaaggggcgtgggaggtgggtggaccaaaacaagtaaaacgaaaaggacggaagtacaacgaaaaactagtgtaggactcgtgtagacggcgacttaccaccatctcagagacaacgacaaacgtatacactgtattagactaaatgaaacagactaggaaggagggacggacggaaccgacggccggttacgtaagtttagttagtgtacggacgtagatacggtaagtaaaggtacgtaactacgttaacaagtagacgtaggtagtagtagagtttagg

SEQ ID NO: 372456 - DNA, 630 bp, Homo sapiens
  misc_feature: GZ8MTXP02FLHFT.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtggggggaggtcttggtccgagggcccgggggggtccctggacgactctcctgtgcagtctctggattcacccttagaagttattggatgacctgggtccgccaggctccgaggggaaggggctgggagtggggtcggaccaaacaataaaacaaagaacggaagtacaaagaaaaacctagtgtgactctggacgacggccgaattacaccgatctaccagacgaacaaaccgaccaaagtattacactagttatttagactaaaatgaaacagaccgtaggagacggacggaacggaaccgacgggtacccgttaaggttatttaagttcgtcggacgtacggagagttagaattaaggtacgtaactacgtaaacgaaggttaacgacgtaagggttaggtactaggactttcgg

SEQ ID NO: 372457 - DNA, 765 bp, Homo sapiens
  misc_feature: GZ8MTXP02HL56L.15.67.G01.1.454.CMB.2.raw
tcagtctacgtagccacgaccggtgctcgatttagagtatacatattgggtttgaggtctcagagaggagccttagccccggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccgaggcccggggggtccctgagactctcctgtgcagtctctggattccacccttagaagttattggatgaccgtggtccgccgagccgtccggaggggaaggggcgtaggaggtggggtacggaccaaacgaataaaaaccgaaaaggaacgggaaagtacaaagtaaaaaactgtacggtagtactcgtaggtacggaacgggcccggtaattccaaacctacgttacctacccgaaaggacgaaacccgaaaccgacccgaaaagtaaacttacctaacgttagttaacgtttacgaacctaaaagtacgaaacgtacggtacccgtaggaaacgggtacggggacgggaacggggtaacccgtaaccgggggtacccggttaaggttaaacgttttaggtttacgggtacgggtaccggacggtaaaggtaaggttaggtaaaagttaaacgggtaacgtacgtttaaccgtaaccgtaagggtaacggtacggtaaaggttcggggtaaattcggtaagtttcggtttaacgg

SEQ ID NO: 372458 - DNA, 593 bp, Homo sapiens
  misc_feature: GZ8MTXP02JK6I2.15.67.G01.1.454.CMB.2.raw
  modified_base (316)..(316): a, c, t, g, unknown or other
  modified_base (334)..(334): a, c, t, g, unknown or other
  modified_base (383)..(383): a, c, t, g, unknown or other
  modified_base (538)..(538): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatgggagttggggctgagcttgggttttccttgttgttattttagaaggtgtccagtgtgaggtgcacttggtggagtcggtggggggaggtcgttggtccgagggccgggggggtccctggagacctctcctgtgcagtctcgtggacttcacccttagaagttagttgatgacctggtccncagctcgagggagggcgnggagtggtggacaacaataaacgaaagaccgtaagacaagaaaaacctntagtaggactcgtgtacgacgggccgtattaccaccattccaccagacgacaaaccgaccaaagtacttacacttgtatttacgactaaaagtgaaactacgaccgtagaggaggacggagacgacggccgtgtacttagtgtgcggagaggtanagtaagtacgtagtaacctcgtataaggaagacggtacggtagtagtgtaacttg

SEQ ID NO: 372459 - DNA, 637 bp, Homo sapiens
  misc_feature: GZ8MTXP02FGTQ3.15.67.G01.1.454.CMB.2.raw
  modified_base (190)..(190): a, c, t, g, unknown or other
  modified_base (507)..(507): a, c, t, g, unknown or other
  modified_base (628)..(628): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtnaggtgcacttggtgagtcgtgggggaggcttggtccgaggccgggggggttccctgacgactctcctgtgcagtctctggacttcacccttagaacgttatggatgacccgtgggtccccgccgaggccgtacccggaggggaaggggtccgtaggggaggtggggtcggacccaaaacaactaaaaccgaaaggaaccggaatacgaaacgaaaaacccctgtacggtaggactcgtcgtacgaccggccaattccacctgtcaccagaacaacaaccgaccaaagtaactcgactgtaattagacaaatcgaacncgaccgtgaacggacggacgtagggacccacgggtaccgtaggttactaaggtcgtcgacggacaggtatagaagttagtacgacctctaacgaaggacgtacggtaaggtggtttaaacngtacgttcg

SEQ ID NO: 372460 - DNA, 835 bp, Homo sapiens
  misc_feature: GZ8MTXP02FHCO6.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttgtgagtcgtgggggagtcgttggtccgacgggtcccggggggttccctggacgtaccttctcctggtcgctagtctcgtggacttccaccccttaagaacgttaattgggatcggaccgtggggtccccgaccgaggccgtcccgagggggaacggggtcgtgggtacggtggggtcggacccaaaacgaactaaaacgaaaacggacggaaagttacgaaaggaaaaaacccccttgtacggtaggtaacctcgtaggttacggaaccggcccgaaactttccaaccagttacctacccgaaaggaaaccgaaaccgaaaacccggttacccaaaaacgggtaacttacccgtacctaaggtttaaacttttaacggaccaaaaacgttaccgaaaaccgtaaacggccccgttagggaaacggaccggggtaaaccgggaacggggtaaccccggaacccggggttacccggtttaacgggtttaaactttaaacggttttagggtacgggtccccgggtaacggtacgggaaactttaacggaaacgttaagggtaaaccgtacctttaaccgtaaacccgaaggttaaacgggtacggttaacgggtacgttaacgtacgtacgttacg

SEQ ID NO: 372461 - DNA, 747 bp, Homo sapiens
  misc_feature: GZ8MTXP02FJO7M.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggtcttggtccagggccgggggggtccctggagactctccgtgtgcagtctcgtggacttcacccttagaagttagtggatgaccgtgggtcccgccgaggcctccgagggggaacggggcgtgggaggtggggtcggaccaaacaataaaacgaaaggacggaaagtaccaaagtaaaaaacccttgtaggtacggacttcgtacggttacgggaacccggggtccgtaactttacccgaaccctaattcccgtacccgaaagaaccgaaaccaaacccgacccgaaaagtaaactttaccaacgttgttaagtttacgacctaaaagtacggaaacacggtaccctaggaaacgggacgggacgggaaacgggaacccgtaaccgggtccgttaaggtttactttaaggttcggttgggaccgacgggtaagaagtttacgggaaacgttaaggtaacgtaaccttcgtaaaccgtaaggtaaggtaccggtagggggttaggtttacgtaggtaaacggttttgg

SEQ ID NO: 372462 - DNA, 806 bp, Homo sapiens
  misc_feature: GZ8MTXP02JL30Q.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgagggcccgggggggtccctggagactctcctgtgcagtctcgtggattcacccttagaagttattggatgacctgggtccgccaggctccgaggggaagggctgggaggtgggtggaccaaacaataaaacgaaagaacggaagtacaaagaaaaaccctgtagtacggactcgtaggtacgaaccgggccgtaattacccaacctattaccctacccgaaaggaaacgaaacccgaaaacccggaccccgtaaaaggtaaactttaccgaaaccgtttacggtttaaagtttttacggaaacccttaaaaagttacggtaaaaacccgaacggtaccccgttaaggggaaacgggacgggggaaccgggtaaacggggaacccgtaaacccgggggtacccggtttaagggtttaaaccttttaggtttacgggttacggaccgggtaccggtaaaggtaggttaacggtaagttaaaaggttaacggtaaacctttaaccgtaaaccgtaaacgggttaacgtacggttaaacgggggttaggtttaaacgttacggggtactttttaacgggg

SEQ ID NO: 372463 - DNA, 758 bp, Homo sapiens
  misc_feature: GZ8MTXP02HONOQ.15.67.G01.1.454.CMB.2.raw
  modified_base (263)..(263): a, c, t, g, unknown or other
  modified_base (299)..(299): a, c, t, g, unknown or other
  modified_base (339)..(339): a, c, t, g, unknown or other
  modified_base (383)..(383): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagagtgtccagtgtgagtgcacttggtgagtcgtgggggagcttggtccaggccggggggtcctgagactctcctgtgcagtctctggnttccacccttagaagttatggatgacctgggtcccncaggcctccgaggggagggctgggaggtggtcggaccaanaagtaaaacgaaaggacggaagtacgaaaggaaaaacctgtagnggaactcgtagtacgaccggtcgtacttccacctacttccgaccacgaagaaccaaaacccggttccaaaggtaacttacctaccgttagttatttacggaaaccctaaaagttacgggaaacctacggaccccgttagggaaacgggagggaccggggaacggaacccggttaaccggggtcccgtttaaggtttaaacgtttacgttttagggtccggtaaacccggggtacggtaaaacggttacgttaacggtaaacggttaaacggttaaaccggttaaccgttaacccgttaaacggttaaccgggttaacggtaaccgggttaacgggggtttaacggtttacggtttacggtttaacggtttcccgg

SEQ ID NO: 372464 - DNA, 635 bp, Homo sapiens
  misc_feature: GZ8MTXP02FTZHM.15.67.G01.1.454.CMB.2.raw
  modified_base (507)..(507): a, c, t, g, unknown or other
  modified_base (561)..(561): a, c, t, g, unknown or other
  modified_base (626)..(626): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttgggtggagtcgtgggggaggcttgggtccgacgggccgggggggtccctggagactctcctgtgcagtctcgtggtacttcacccttaagtaagttattggatcgaccgtcgggtcccgccgaggtcctaccgaggggaaggggctgggagtggggtacggaccaaagaactaaaacgaaagaccgggaaatacgaaagaaaaacctagtgtacggactcgtgtacggacgggccgtaattccaacctctctaccgagacgaactaacgaccaaagactacactgttattgacaaagtagaaacngtaccgaggaggacggacggtaacggacgtaccgggtacgtagttacgtttagnggtcgacggaggatagtcggtaaattacgagtaacctcgttaagaagtcgacgtaggtagtagtnaccggttta

SEQ ID NO: 372465 - DNA, 658 bp, Homo sapiens
  misc_feature: GZ8MTXP02JJFKM.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggtttcctgtgttattttagaaggtgtcagtgtgagtgcagttggtggagtcgtgggggagtcttggtccacgggccggggggtcctggacgctctccgtgtagcagtctcgtggacttcaccgttagagttattggatgaccgtggtccgcgtacggctccgaggggtaagggcgtggacggttggggcggaccaaacgaactaaaaacgaaacgacggaaagtacaaaaggttaaaaaaccctgtacgtagaaccttgtaggacggaacggcccgtaattcccacctagttacaccgagaaacaccgaaaccgtcaaaaggtaattacgaaccttgttaagttacgaaactaaaccgtaggaaaaccacgtacgaggaaggacggacggaaagaccgtacggtacgttagtttacgttggtacggtcgacggacgtagaagtacgtaagtaacgttaacgacttacgaagtaacgtacgaacggtaggtacgtagtggtactg

SEQ ID NO: 372466 - DNA, 788 bp, Homo sapiens
  misc_feature: GZ8MTXP02F33AG.15.67.G01.1.454.CMB.2.raw
  modified_base (203)..(203): a, c, t, g, unknown or other
  modified_base (263)..(263): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggnggagtcgtgggggagcttggtccagggccggggggtcctgagactctcctgtgcagtctntgatctaccttagagttatggatgacgtggtccgccaggctccgaggggaaggcgtggaggtgggtcggaccaaagaaataaaacgaaaaggaacggaaacgtacaaaacggtaaaaaccctagttaggtacggtaacttcgtaggttacgggaccgggtaccgactttaccgaacctagtacccgtacccaaagacgaaacctaaaacccggaccaaaacgtaaacgtttacccaacgtttacgtttaagttttacgaaacctaaaaagtttacggaaaaccgttaaacggtcccgtaagggaagggacgggaaacccggggtaaagggtaaccccggaccggggtaccgtttagggttttaaaacgtttagttacggggttaggcccgggttaacggtaaggaagttaaacggggttaaaaccttaaacgggttaacccggtaaacgtttaccctaaaacggtaacggtttacggaacggttaaacggggtttaggttaccgttaacgggtaactttttaggg

SEQ ID NO: 372467 - DNA, 610 bp, Homo sapiens
  misc_feature: GZ8MTXP02J1FOL.15.67.G01.1.454.CMB.2.raw
  modified_base (400)..(400): a, c, t, g, unknown or other
  modified_base (534)..(534): a, c, t, g, unknown or other
  modified_base (582)..(582): a, c, t, g, unknown or other
  modified_base (601)..(601): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccgaggcccgggggggtccctggagacctctcctgtgcagtctctggacttcacccttagaagttattggatgaccgtgggtccgccaggctccgaggggaaggggctggaggtggggtggccaaacataaaacaaagacggaagtcaaagaaaaaccctgtagtacggactntcgtaggaccggccgtattccaccattcaccagaacgaaccaaccgaccaaagtaattcacgttagtaactttgaactaaatacgaacgagcctaggagagggacggaaggacgtaccggtccgtgttaagttnttgggtcgcgtacggagtataggaagttacgtacgccttaacgtacgngtaacgcgtagggtagtancggtattcg

SEQ ID NO: 372468 - DNA, 625 bp, Homo sapiens
  misc_feature: GZ8MTXP02FXZBD.15.67.G01.1.454.CMB.2.raw
  modified_base (411)..(411): a, c, t, g, unknown or other
  modified_base (569)..(569): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgtttatttagaaggtgtccagtgtgaggtgcacgttggtggagtcggtgggggaggtcgttggtccgagggcccggggggtccctggacgtactcctccgtgtgcagtctcgtggacttcacccttagtaagttagttggatgaccgtgggtcccgccgaggctaccgaggggaacggggctagggaggtggggtcgaccaaacgaataaaacgaaaagacggaaagtacaaagaaaaacctagngtaggactcgtagacgacggtcattccaccatctacgaagaacgaacaaaccgaccaaagaacgttctaactgttaatttacgaactaaatcgaaacacgcctaggagacggacggaacgacgacggccgttagttacttagtcgtggagcggagtanggtaatacggtacgactgttaacgaagtagcggtaggttggtagtcggtattacgg

SEQ ID NO: 372469 - DNA, 679 bp, Homo sapiens
  misc_feature: GZ8MTXP02GC8MV.15.67.G01.1.454.CMB.2.raw
  modified_base (614)..(614): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtggaggtgcacgttggtggagttcgtgggggagtcttgggtccagggcccggggggtccctggacgtaccttctccgtgtgcgtagtctcgtggtacttctacccttaagtaagtagttggatcgtaccgtcggtcccgcgagccgtcggaggggaagggtcgtgggaggtggggtcgaccgaaaacaaagtaaaaacggaaaggaaccggaaagtaacgaaaacgaaaaaccgttgtacggtacggtaactcgtaggtacggaccgggtacctacttaccgaaccctattacccgacgaacggaaacgtaaacccgaaaccgaacccgaaaagtaaccttcgtaaactgtttaattaagaactaaaatacggaaacacgtcgtaggacgagggacggtagaaccgcggtctagttatagtgcgngacgatagtataacgtagtaacgtactactaagaacgtagtacgaggttcgtaagtgagtttacg

SEQ ID NO: 372470 - DNA, 597 bp, Homo sapiens
  misc_feature: GZ8MTXP02JAR58.15.67.G01.1.454.CMB.2.raw
  modified_base (322)..(322): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgactgggtccgcaggctccgagggagggcnggagtgggtgccaaacataaaacaaagacggaatacaaagaaaaacctagtagtaggactcgtagtagaccggccgtaattaccgaccatcctaccaagaacgacaaacgaccaaagaacttacactagtaatttacgactaaaatgaaacacgaccgtaggagaggacggaaggaaccgacgggccgtagttagttagttaggtgacgcgaagatagaatagtacgtacctacgtaacgaagttagacgtaggtaggtatacggtagtttacgg

SEQ ID NO: 372471 - DNA, 652 bp, Homo sapiens
  misc_feature: GZ8MTXP02GNSHX.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtggaggtgcacgttggtggagtcggtgggggaggtcttggtccgagggcccgggggggtccctggagactctcctgtcgcagtctcgtggtacttcctaccttagtaagttattggagtcgaccgttgggcccgaccgaggcctccggaaggggaacggggcgtaggggaggtggggtacggaccaaagaaataaaacgaaaggaaacggaagtacaaaaggaaaaacctagtaggtacgtaactcgtaggtacggaccgggcctattaccacctagtccacagaacgaacaaacgaccaaagtactacaacttgtattagaacaaatagaaaccagccgtagagacggcggtaacggaccgtacgggacgtttagtaattagttggcgacgacgtagagttacgaaagtacggtataccgtcgtaagaaggtagacggtaaggttggaattggtatttaccgg

SEQ ID NO: 372472 - DNA, 646 bp, Homo sapiens
  misc_feature: GZ8MTXP02HXE7C.15.67.G01.1.454.CMB.2.raw
  modified_base (306)..(306): a, c, t, g, unknown or other
  modified_base (309)..(309): a, c, t, g, unknown or other
  modified_base (341)..(341): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctggagactctcctgtgcagtctctggattccaccttagaagttatggatgacctgggtccnccnggctccgaggggagggctggagtggtgccaanataaacaaagacgaagtacaagaaaaccctagtgtggactctgtagaccggccattccaccatccacagacgacaacgaccaaagtaacttcgaactggttatttacggacctaaaatcgaaaacacggtacccgtaggaaggacgggaccggaagggaaacccgaccggggtacccggtttagttaacgtttaagtttcggacggtacccggtacggtagtagttacggaaattaaacggttacgaccctttacgaacctaaggttacggacgttaggggttaggttacgtaggtaactttcgg

SEQ ID NO: 372473 - DNA, 595 bp, Homo sapiens
  misc_feature: GZ8MTXP02GLJCF.15.67.G01.1.454.CMB.2.raw
  modified_base (338)..(338): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctcgtggattcaccttagagttattggatgaccgtggccgcgaggctcgagggagggctggagtgggcgaccaanaataaacgaaaggacggaatacaaagaaaaacctgtgtaggacttcgtgtacggaccggccgtattccgacctatcctaccaagacgaacaaaccgaccaaagtaactcacttagttatttacgaactaaagtacgaaaccagtcctagggagacgggacggaggtaccgaccgggtccgtaggttaattgttgtgccgaggatagtggataggtacgacctctaacgaaggtagacgtaggtgtagtgtactttgg

SEQ ID NO: 372474 - DNA, 569 bp, Homo sapiens
  misc_feature: GZ8MTXP02GSEDL.15.67.G01.1.454.CMB.2.raw
  modified_base (340)..(340): a, c, t, g, unknown or other
  modified_base (372)..(372): a, c, t, g, unknown or other
  modified_base (413)..(413): a, c, t, g, unknown or other
  modified_base (538)..(538): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggccgggggggtccctgagactctctgtgcagtctctggattcaccttagagttatggatgacctgggtccgcaggctccgaggggtaggggctggagtgggtggccaanataaaacaagacggaagtcaaagaaaaacctntgtaggactctggtagaccgggccgtaattccacaacttcncagaagacaaacggcccaaaagattacacgtattatttgacaaatgaaacagccgtagagaggcgaggacgtacggccgtagtacttagttagtgcggcgtagagtcgaagtacgtacacgttanagtaagtacgagtaggtagtactagtcgttg

SEQ ID NO: 372475 - DNA, 595 bp, Homo sapiens
  misc_feature: GZ8MTXP02JKK4H.15.67.G01.1.454.CMB.2.raw
  modified_base (308)..(308): a, c, t, g, unknown or other
  modified_base (393)..(393): a, c, t, g, unknown or other
  modified_base (434)..(434): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccgaggcccgggggggtccctgagactctcctgtgcagtctcgtggattcacccttagaagttattggatgaccgtgggtccncacggctccgaggggaaggggctgggaggtgggtcggaccaaacgaataaaacgaaagacggaaagtaccgaaagaaaaaccctntggtaggaactcgtggtacgaccgggcccgaattccaaccntcctaccagacgacaaacgccaaagacttcacgtagtatttacgactaaagtgaaacagcctaggagagggaccgaggaccgacggtaccgtgttattagtgtgcgacgtagatgatacggtactactctaacgaagtacgacgaggtaggtatgagtttg

SEQ ID NO: 372476 - DNA, 689 bp, Homo sapiens
  misc_feature: GZ8MTXP02IMPEH.15.67.G01.1.454.CMB.2.raw
  modified_base (272)..(272): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccgagggcccgggggggtccctggagactctcctggtgcagtctntggattcacccttagaagttattggatcgaccgtcggtccgccaggcctcgaggggaagggcgtaggaggtgggtcggaccaaaacaagtaaaacgaaaggtaaccggaaagtacgaaagtaaaaaccctgtaggtaggtacctcgttaggaggaccggggtccaatttaccgacctattccgaccgaagaacacgaaaccgacctaaagaaacttctaactagtttaatttacgaataaaactagaaactacgcgtacggagaacggggacggaaaggcccgtaacgggtaccgttagttaactttagtacggtcgaccgggtacgaaggtatagggtaaacttaagggtaaactaccgtaaccgttaagaaggtaacggtacgggtagggttacggttaataggtaacgtttcgg

SEQ ID NO: 372477 - DNA, 610 bp, Homo sapiens
  misc_feature: GZ8MTXP02J1GFB.15.67.G01.1.454.CMB.2.raw
  modified_base (346)..(346): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggaggcttgggtccaggccgggggggtccctggagactctcctgtgcagtctctggattcacccttagaagttatggatgacctgggtccgcaggctccgaggggaagggctaggagtggggtggccaaanataaaacaaaagaccggaaagtcaaagaaaaaccctagtgtaggaactctagtgacgggccgaattcactatcaccagacgaacaacggacccaaagaaactttcaacttagtattttaggaacctaaagtacgaaaacacgttacctaggaagagggaccggaagggaacaccggggtaccgagttaatttagtcgtacgcgtacggagacgtagaattacgacgaactaccttaagaagtagacagggtaggtatagtactg

SEQ ID NO: 372478 - DNA, 747 bp, Homo sapiens
  misc_feature: GZ8MTXP02IM08L.15.67.G01.1.454.CMB.2.raw
  modified_base (655)..(655): a, c, t, g, unknown or other
  modified_base (745)..(745): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttatttagaaggtgtccagtgtggaggtgctacgttgggtggtaggtcggtggggggaggtcgtttggtacccgacggggcccggggggttcccggtcggagaccttctccgtgtgctagttcgtcgtggacttctaccctaagtagttagtgtatcgaccgtcgggtcccgccgacggcgaccgagggggaacggggtcgaggggtggtcggggtacggacccgtaaaacgaaacttaaaaacgaaaaggaacgggtaaacgtaacggaaaactaaaaacgtaagtaggtacggtacgtctacgggtaacgaccggggtccgtacttaccgtaaacccgcttaccaccgtacgaaacgtaaccaaaccccggataaaacggtaaccttactaaccgttatttacgtttaacaaacgtaaaacgtgaaaccgtaacccggtccgtaaagaggggaacgtacggggaacggaaccgtccggttacggttnttaaagtttgttcggacggtacacggtaagcttagggaaattacggtacgtacctattaaaccgaagtgacggtggtagtacgtaggttntg

SEQ ID NO: 372479 - DNA, 601 bp, Homo sapiens
  misc_feature: GZ8MTXP02IWIFL.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtgggaggtcgtgggggaggcgttggtccgaggccgggggggtccctgagacctctcctgtgcagtctctggattcacccttagaagttattggatgaccgtgggtccgccaggcctccgagggggaaggggcgtagggaggtggggtaggcccaaacaataaaacgaaaaggacgggaaatcaaagtaaaaaccctgtaggtggacttctggtagaccgggccgattccacctatctaccagagacaaccgccaaagaattcatcgtatttagactaaatcgaaacacgtcctaggaagagggcgaacggacacgggccgttgtatttagttcgtgcgagagatgaacgttagtacgacttctagaagtacggacgtagggtaggtaactgacgtttg

SEQ ID NO: 372480 - DNA, 778 bp, Homo sapiens
  misc_feature: GZ8MTXP02I3U33.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttgggtggagtcgtgggggaggcgttggtccgacgggcccgggggggtccctggacgactctcctgtgcagtctctggattccacccttagaagttattggatgaccgtgggtcccgccgaggcctccgaggggaaggggcgtggggaggtggggtcggaccaaacaagtaaaaccaaaaggaccgggaaatacgaaagaaaaaaccctgtagtacggacttcgtgtacggaccggggcccgtagtttaccacccgtatcctacccaagaacgaaccgaaaccgaaccctaaagaaactttcaccgttaggttattttacggaactaaaagtaggaaaactacggtacccgtaggaacgggaacgggacgggtaaacgggaaacccggtaacccgggggtacccggtttaacggtttaaactttttaaggtttgggttaccgggttaccggaccggtaaaggtagtttacggtaaaaggttaaaggttaaaccggtaaccttacccgttaaagtaaccggggttaacggtacggttaaacgggggttaggttaaacgtttcgggtaaacggtttttacgg

SEQ ID NO: 372481 - DNA, 656 bp, Homo sapiens
  misc_feature: GZ8MTXP02JB653.15.67.G01.1.454.CMB.2.raw
  modified_base (266)..(266): a, c, t, g, unknown or other
  modified_base (297)..(297): a, c, t, g, unknown or other
  modified_base (424)..(424): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttgggtggaggtcgtgggggaggtcttggtccgagggcccggggggtccctgacgactctcctgtgcngtctcgtggattcacccttagaagttatggntgacgtggtccgccaggctccgaggggaagggcgtggaggtggggtcggaccaacaagtaaaacaaaaggacggaagtacaaagaaaaacctataggtagactctggttagacggggccattcaccncttaccacccaagaagaacaaacccgtacccgaaaagtaactttaccacgttagttagtttagaacctaaaagtacgaaacacggtaccctaggacggaacgggacgggaacggtaaccgacggacccggttagttagtttagttagtcgcggacgagtagtacggtaattacggaacgtaccttacgttaaacaaggtaagtacgtaggggttagtacgtagtaacgtttg

SEQ ID NO: 372482 - DNA, 661 bp, Homo sapiens
  misc_feature: GZ8MTXP02GAU2T.15.67.G01.1.454.CMB.2.raw
tcagtctacgtagccacgaccggtgctcgatttagagtatacatattgggtttgaggtctcagagaggagccttagccctggactccaaggccctttccacttggtgatcagcactgagcacagaggactcaccatggagttggggctgagctgggttttccttgttgttattttagaaggtgtccagtgtgaggtgcagttgggtggagtcgtgggggaggtcgtttggtccgagggcccgggggggttccctggagactctccgtgtgcagtctctggattcacccttagtaagttatggatgaccgtgggtccgcaggctccgaggggaagggctgggaggtgggtcggaccaaacgaataaaacgaaagaacggaaagtacaaaggaaaaacctacgtagtagggaccttgtaggtacgggaccgggtccaatttccaacccattcgaccgaagaacgaacaaaccggtacccaaaagtaacttcaacgttgtttaagtttacgaactaaaaagtagaaaccacgtaccgtagggaaggacgggacgggaacggaccgacggggtaccgttagtttaaagtagtttgtaggccggtacgaggtatagaattaaggtacgtactacttaagaagttacgagaggtcggtatgctttag

SEQ ID NO: 372483 - DNA, 562 bp, Homo sapiens
  misc_feature: GZ8MTXP02FKVUX.15.67.G01.1.454.CMB.2.raw
  modified_base (343)..(343): a, c, t, g, unknown or other
  modified_base (379)..(379): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccagccgggggggtccctgagactctcctgtgcagtctctggattcacccttagaagttattggatgacctgggtccgccaggctccaggggaaggggctggagtggggtggccaaanataaaacgaaagacggaagtcaagaaaaacctatgnggactctgtgacggccgattcaccatcctcagagaccaaacgaccaaagaattcactgttaatttgcaaaagtgaaacacgacctggaagagggacgaagggaccacggccgttaggtaacttagttcgtagcgacgagattagatagtacgactctacgaagtagcgaggtggtatggattg

SEQ ID NO: 372484 - DNA, 610 bp, Homo sapiens
  misc_feature: GZ8MTXP02F8WZ7.15.67.G01.1.454.CMB.2.raw
  modified_base (352)..(352): a, c, t, g, unknown or other
  modified_base (484)..(484): a, c, t, g, unknown or other
  modified_base (573)..(573): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggtcgttggtccgagggcccgggggggtccctggacgactctcctgtgcagtctctggattcacccttagaagttattggatcgaccgtgggtccgccaggctccgaggggagggctggagtgggtggccaanataaaacaaaggacggaagtacaagaaaaacctagtgtagactgtgtagacgggccgtattccacctatctaccgaagacgaacaaaccgaccaaaggaattccaactgttatttagactaaaatcgaaacncgaccgtaggaaggagggacggaggaaccgaccgggccgttaggttattagttacggtgccgacggagagtagaagtacgtagaacctnaacgtaagtacgtacgagggtaggtacgtgatttagg

SEQ ID NO: 372485 - DNA, 607 bp, Homo sapiens
  misc_feature: GZ8MTXP02HWOGI.15.67.G01.1.454.CMB.2.raw
  modified_base (290)..(290): a, c, t, g, unknown or other
  modified_base (307)..(307): a, c, t, g, unknown or other
  modified_base (376)..(376): a, c, t, g, unknown or other
  modified_base (387)..(387): a, c, t, g, unknown or other
  modified_base (423)..(423): a, c, t, g, unknown or other
  modified_base (532)..(532): a, c, t, g, unknown or other
tcagtctacgtagccacgaccggtgctcgatttagagtatacatattgggtttgaggtctcagagaggagccttagcccctggactccaaggcctttccacttggtgatcagcactgagcacagaggactcaccatggagttggggctgagctggggttttccttgttgttattttagaaggtgtccagtgtgaggtgcacttgggtggagtctggggggaggcttggtccaggccgggggggtccctgagactctcctgtgcagtctctggattcacccttagaagttnttggatgacctgggtcnccaggctccaggggagggctggagtgggtggccaacataaacaaaggacggtaagtcaagaaaaacctntagtgaacctntgtacgacgggccggattccgacctaatctccaganaaccaacgcctaaagaacttcaactgttaatttggacctaaaagtggaaacaggacctaggagacgggacggacggaacaccgggtaaccgtggtatttagttacgggngcgacgtaagagtacgtaacgttaacgtacgtactacgtaaacgaagtacgacgtaggtagtacgtacgtagtcg

SEQ ID NO: 372486 - DNA, 700 bp, Homo sapiens
  misc_feature: GZ8MTXP02FL717.15.67.G01.1.454.CMB.2.raw
  modified_base (352)..(352): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttgggtccgagggcccgggggggtccctggagactctcctgtgcagtctctggattcacccttagaagttattggatgaccgtgggtccgccaggctccgaggggagggctggagtggggtggaccaaanaataaaacgaaagaacggaaagtacaaaggaaaaacctagtgtacggactcgtagtacggaacggccgaattccaaccaacttccgtaccaagacgaaaccgaaaccgacccaaaaggtaaacttacctaacttggttaattttacggaactaaaaacttacggaaaactaacggacccgttagggaagggaaacgggacggggtaacgggaaccgaaccggggtcccgttaaggttaactttaggttcgtcgggaccgtacgggagtatacggaagttaaacgtagtaaccttacgttaaccgaaggttaacgacggtaaaggggttggtaaacttcggtaagtttg

SEQ ID NO: 372487 - DNA, 594 bp, Homo sapiens
  misc_feature: GZ8MTXP02IPVM5.15.67.G01.1.454.CMB.2.raw
  modified_base (472)..(472): a, c, t, g, unknown or other
  modified_base (478)..(478): a, c, t, g, unknown or other
  modified_base (481)..(481): a, c, t, g, unknown or other
  modified_base (484)..(484): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggcttggtccaggccgggggggtccctgagactctcctgtgcagtctctggattcaccctagaagttaattggatgacctggtccgccaggctccgaggggaaggggctgggagtggggtggaccaaaacaataaaaacaaaagaacggaaagtacaaagaaaaaaacctatagtagggactcgtagttgaacgggccgaattccaacccatcctaccaagaagacaaaacgccaaagaaattacactatattanacaaanaanaanaacacagagagaggagacgacgacgtagtattattgtgcgacgagagtagtaagtaagtaacgtaactaacgtaacgtaacgtaacgacggaggtaggtagtagtagtag

SEQ ID NO: 372488 - DNA, 793 bp, Homo sapiens
  misc_feature: GZ8MTXP02HL5K4.15.67.G01.1.454.CMB.2.raw
  modified_base (351)..(351): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctgagtactctcctgtgctagtctcgtggattcacccttagaagttagtggatgaccgtggtccgcaggctccgaggggacgggctgggaggtgggtcgaccaaanaataaaacgaaagaacggaagtacgaaagtaaaaacctgtagtggaacttgtaggtaacgaccggggtccgtaatacccgacctaacttcccgaacccgaagaaccgaaacccgtaaacccggaacccaaaaggtaactttacccctaacgtttacggtttaagttttacggaaacctttaaaaagtcgtaaaacccgacggtaacccggttaagggtaaccgggagggggaacccggtaaacggggaaccccgttacccgggggttaccggtttaaagggtttaacgttttaagtttacccggggtttggacccggttacggaaaaaggttcgttaaacggggtaaagtttaccccggtaaaaggtacctttaaccgtaaaccgtaacgggttaggaaccgggtaggggtttaggtaaacgtttccgggttaattttccgg

SEQ ID NO: 372489 - DNA, 580 bp, Homo sapiens
  misc_feature: GZ8MTXP02I2GB2.15.67.G01.1.454.CMB.2.raw
  modified_base (246)..(246): a, c, t, g, unknown or other
  modified_base (305)..(305): a, c, t, g, unknown or other
  modified_base (338)..(338): a, c, t, g, unknown or other
  modified_base (371)..(371): a, c, t, g, unknown or other
  modified_base (461)..(461): a, c, t, g, unknown or other
  modified_base (472)..(472): a, c, t, g, unknown or other
  modified_base (533)..(533): a, c, t, g, unknown or other
  modified_base (554)..(554): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttgggtggaggtcgtgggggaggcttgggtccgaggccggggggtccngagactctctgtgcagtctctggattcacccttagaagttatggatgacctgggtcccnccaggctccgaggggaagggctggaggtggggngaccaacataaaacaaaggtaacggaatacaanaaaaaccgtatgtagactcgtagtgaccggcgtattcaccatcaccagcgaacacgacaagaacttcactgtatttgactaaatgaaacngacctgaaggnggacgaaggacgacggccggtgttaattgttagtgcggacgagagttggaaactaggtaanaccttcgtaacaaggtaaacncggaaggtgtaacgtagtaacgtttg

SEQ ID NO: 372490 - DNA, 599 bp, Homo sapiens
  misc_feature: GZ8MTXP02FFCYG.15.67.G01.1.454.CMB.2.raw
  modified_base (303)..(303): a, c, t, g, unknown or other
  modified_base (481)..(481): a, c, t, g, unknown or other
  modified_base (542)..(542): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacttggtggagtcgtgggggaggcttggtccaggccgggggggtccctgagactctcctgtgcagtctctggattcacccttagagttattggatgacctgggtccncaggctccaggggaagggtcgtggagtggggtggccaaacgaataaacgaaaagacggaaagtcaagaaaaaaccctgtagtggactcgtagtaggaccggccgaatttcgaacccatcctaccagacgacaaaccgacccaaagaattcactgttaatttgacaaaagtcgaaaacngacctaggacggaggacggagggaccgtaacggccggttagtacgttaattggtagccggngaggatgaataacggtagacctacgtaacaaggttagcgtagggtgtaatgacgttg

SEQ ID NO: 372491 - DNA, 691 bp, Homo sapiens
  misc_feature: GZ8MTXP02F7FVO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccgaggcccgggggggtccctgagactctcctgtgcagtctctggtacttcacccttagaagttattgggtatgaccgttgggtcccgccgaggcgtccgaggggaacggggcgtgggaggtgggtggacccaaaacaaacgtaaaaacaaaaggaacgggaaagtaccgaaaagaaaaaaccccgtagtgtaggacttcgtagggttacgaacccgggccgtaacttccaaccctactacgtacccaggaaacgaaccgaaaccggtacccaaaagtaaacttacaaccttaggttaacttttagacaaaattcggaaaacacgaccgtgaaagggacggacgggaaggtaaccgtaccgggtccgttagtttaacgttagttagtcgccggacgaaggtatagacttaaaggtacgtactaccgttaaacaaggtagacgtagggtagtataggtactttgg

SEQ ID NO: 372492 - DNA, 683 bp, Homo sapiens
  misc_feature: GZ8MTXP02J1KBH.15.67.G01.1.454.CMB.2.raw
  modified_base (341)..(341): a, c, t, g, unknown or other
  modified_base (539)..(539): a, c, t, g, unknown or other
  modified_base (662)..(662): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttccttgttgttatttagaaggtgtccagtgtgaggtgcattggtggaggtcgtgggggaggcgttgggtccagggcccggggggggtccctggacgtacctctccgtgtgctagttcttcgtggtacttcctaaccccgttaagtaagtttagttgggatcgtaccggtcgggtcccgaccgnggtccgtaccggagggggtaacgggcgtgggtaggtggggtcggacccaaacgaaataaaacgaaaggaacgggtaaataccgaaagtaaaaaccttagtggttagacttcgtaggtaggaccggtaccggtacttaccgaacctacttaccctaccgaagaacgaacaaaacccggacctaaaagtactactagttntaactttgaataaatcgaaacagtccagcggaggaccggaagtaccacgggtcgtagttagttattggacgcgtagagtagtagtaactaaggtaccatttaaccgataacgggtacgtacgngggtttaaggtctagtagtcg

SEQ ID NO: 372493 - DNA, 635 bp, Homo sapiens
  misc_feature: GZ8MTXP02FNQ7U.15.67.G01.1.454.CMB.2.raw
  modified_base (349)..(349): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttggtggagtcgtgggggaggcttggtccgagggccggggggtcctggagactctcctgtgcagtctgtggtattcaccttagaagttattggatcgaccgtgggtccgccaggcctacgaggggagggcgtggaggtgggtcgccaaanaagtaaacgaaagaacggaagtacaagaaaacctagtgtagactcgtgtacgacggcattcacctatctacaagacgaacaacgaccaaagaacttcacgtgttaatttagactaaaagtgaaacagcccttaggacggagggacggaaacgggacccgtaacggggaccgtttagttaagttagttcggtagacggacggaagagttacggtaagtaacggttagtaaccttacgtaacgtaaggttacggacggtaggggttaggttacgtaggtacgtttcgg

SEQ ID NO: 372494 - DNA, 560 bp, Homo sapiens
  misc_feature: GZ8MTXP02IOJFT.15.67.G01.1.454.CMB.2.raw
  modified_base (344)..(344): a, c, t, g, unknown or other
  modified_base (374)..(374): a, c, t, g, unknown or other
  modified_base (412)..(412): a, c, t, g, unknown or other
  modified_base (446)..(446): a, c, t, g, unknown or other
  modified_base (497)..(497): a, c, t, g, unknown or other
tcagtctacgtagccacgaccggtgctcgatttagagtatacatattgggtttgaggtctcagagaggagcccttagccctggactccaaggcctttccacttggtgatcagcactgagcacagaggactcaccatggagttggggctgagctgggttttccttgttgttattttagaaggtgtccagtgtgaggtgcacttgggtggagtcgtgggggaggcttggtccaggccggggggtccctgaaactctcctgtgcagtctctggattcacccttagaagttattggatgacctgggtcccgcaggcctccgagggaaggggctggagtgggtgccaanataaacaagacggaaagtcaaagaaaactntagtggactctgtgaacgccgattcaccatcctcaganacacgcaagatcactgtatttgactaaatgaacngcccgtggaaggaggacgtagggaaccacgggccgtagtattatggtgcgngaatgtgacttaaggactactactaactaggtaagcgtaaggtcggtatacgtagtcgtttag

SEQ ID NO: 372495 - DNA, 578 bp, Homo sapiens
  misc_feature: GZ8MTXP02I09G3.15.67.G01.1.454.CMB.2.raw
  modified_base (304)..(304): a, c, t, g, unknown or other
  modified_base (323)..(323): a, c, t, g, unknown or other
  modified_base (337)..(337): a, c, t, g, unknown or other
  modified_base (365)..(365): a, c, t, g, unknown or other
  modified_base (397)..(397): a, c, t, g, unknown or other
  modified_base (429)..(429): a, c, t, g, unknown or other
  modified_base (500)..(500): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaagtgtccagtgtgaggtgcacgttggtggagtcgtgggggaggcttggtccaggccgggggggtccctgagactctcctgtgcagtctctggattcacccttagaagttattggatgacctgggtccncaggctccaggggagggcnggagtggtgccaanataaacaaagacggaatcagaaaaactntgtggaacttctgtagacggcgattccacctntctccaagagacaacgtccaaagacttcactntaatttcgacaaatgaaacagtcctagagaggcgaaggaccgaacgggtccgttagtaaagttgtttcggngtacgacgtagagttacgtacgtagtacgtacgttacgtacgaacggtagacggtaggtcggtaagttcggactttcg

SEQ ID NO: 372496 - DNA, 581 bp, Homo sapiens
  misc_feature: GZ8MTXP02G0P8F.15.67.G01.1.454.CMB.2.raw
  modified_base (266)..(266): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcattggtggagtcgtgggggaggtcgttggtccgagggcccgggggggtccctggagactctcctgtgcngtctctggattcacccttagaagttattggatgacctaggtccgcaggctccgaggggaagggcgtgggaggtggggtggaccaacaaataaaacgaaacggaacggaaagtacgaaagaaaaacctataggtaggactgtaggtagacggccgattaccaccatctccagacgaacaacgacaaagatcactgtattagacaaatagaaacacgacctagagacgggacgacggacgacggccgtagtattagttgtacgcggtcgagtatgagtagtacgactcgtaacgaagtgacgtaggtgtatgatttg

SEQ ID NO: 372497 - DNA, 776 bp, Homo sapiens
  misc_feature: GZ8MTXP02JZWIR.15.67.G01.1.454.CMB.2.raw
  modified_base (674)..(674): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcggtgggggaggcgttcggtccgagggcccgggggggttccctggacgtaccttcctccgtgtgctagttctcgtggtattcctacccgttagaagtttagttggatggaccgtgggtcccgccgaggctccgaaggggacggggctgggaggtgggtcggacccaaacgaaataaaacgaaaggacggtaaagtacgaaagaaaaaaccctgtaggtaggacttcgtaggtacggaaccgggccgtaacttaccacctaagtcctaccgaaagacgaaacaaccgaaccctaaagaaacttcaacttaggttaattttacggaactaaaagtacgaaacgtaacggtacccgtagggaagggaacggggaccggaaaagggggtaacccgaaacccgggggttccggtttaagggtttaacttttaaacggttgggttacggaccggttaccgggaaaaggtntaaagggtaaagttaaacgggtaacgttaacccggttacctaaacgtaacgggttaattaaccggggtaggggtttaagggtacgttaggtacgttttacgg

SEQ ID NO: 372498 - DNA, 653 bp, Homo sapiens
  misc_feature: GZ8MTXP02GYM0L.15.67.G01.1.454.CMB.2.raw
  modified_base (305)..(305): a, c, t, g, unknown or other
  modified_base (308)..(308): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacttggtggagtcgtgggggaggtcgttggtccgaggccggggggtcctgagactctcctgtgcagtctctggattccaccttagtaagttatggatgaccgtggtccncgngctccggaggggagggctggggagtggggtcgaccaacgaaataaaacgaaaggaacggaagtacgaaagtaaaaacctgtagtacggaacttcgtaggtacgaccgggtccgtaacttccaacctacttccgtaccaaggaaacgtaccgaaaccggacctaaaagtaaccttctaacggttattacgtttagaactaaagtacgaaactcgacctaggacgaacgggacgggacgtaaccgaacggtccgtagttaagttgtggtcggcgaggtacgtagtagtaagtacgtaacgactaacgacgtaagttcgacggtaggtaggtaactggtaactttcgg

SEQ ID NO: 372499 - DNA, 634 bp, Homo sapiens
  misc_feature: GZ8MTXP02IIT1D.15.67.G01.1.454.CMB.2.raw
  modified_base (338)..(338): a, c, t, g, unknown or other
  modified_base (345)..(345): a, c, t, g, unknown or other
  modified_base (371)..(371): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggtttttccttgttgttattttagaggtgtccagtgtgaggtgcacttgggtggagtcgtgggggaggtcttggccgaggccgggggggtccctgagacctctcctgtgcagtctctggattcaccttagtaagttattggatgaccgtggtccgcgaggctaccgagggaggggctggagtggnggccaanataaacaaagacgatacaagaaactngtagactcgtgacgacggggcctattaccgacctactctaccgaaagacgactaaaccggacaaagtaacttcacttaggttaactttagactaaaatcgaaacctacggaccgtagggaagagggacggaacgggtaccgaaccgggtccgttagttaacgtttagttggtaggccgtacgaaggtgtacggtaagttacgtaacgtactttaaccgagtaaggttaggacgttacggggttaggtattacggtgtttacgg

SEQ ID NO: 372500 - DNA, 730 bp, Homo sapiens
  misc_feature: GZ8MTXP02GVBEL.15.67.G01.1.454.CMB.2.raw
  modified_base (559)..(559): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccgagggcccgggggggtccctggagactctcctgtcgcagtctcgtggacttccaacccttagaagttattggatcgaccgtggggtcccgccgtaggcctcccgaagggggaaggggcgtgggaggtggggtcggacccaaaacgtaaataaaaccgaaaaggaacggtaaagtaaccaaaagaaaaacctagtaggtaggacctgtaggttacggaccgggtcctaatttaccacctacgtcctaccgaagaacgaacccaaaccggacccaaaagtaacttacaaccgttgtttaagtttacgaaccttaaaagtacgggtaaaaccnggtaaccctagggacggacgggacgggaaacgggacccgtaaccggggtccggttagtttaacgtttaagttcggtaggacccgacggtaagtagttacggaaagttaggtaacgaccttacgttaagaagttaaccggagttaggggttagtacgttacgagttttacgg

SEQ ID NO: 372501 - DNA, 642 bp, Homo sapiens
  misc_feature: GZ8MTXP02ITZT5.15.67.G01.1.454.CMB.2.raw
  modified_base (333)..(333): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggattccacccttagaagttatggatcgaccgtgggtccgccaggctccgaggggaagggttcgngggaggtgggtcggaccaaaacaataaaacgaaaggaaccggaaagtacgaaagaaaaaacctagtaggtaggaactcgtaggtacgaccggccgtaattccaaccattccaccaaagaacgaaccgaaaccgacccaaagtaacttcaacttagttaatttagaacaaaagtacgaaacagaccgtaggaggagggtacggaaggaaccgacgggaccgttagttacgttagttggtcgcggacgagagtggaaacttaggtacgtacctacaactaaggtagacgtaaggtggtatacggtatttcg

SEQ ID NO: 372502 - DNA, 558 bp, Homo sapiens
  misc_feature: GZ8MTXP02IHPFT.15.67.G01.1.454.CMB.2.raw
  modified_base (309)..(309): a, c, t, g, unknown or other
  modified_base (326)..(326): a, c, t, g, unknown or other
  modified_base (342)..(342): a, c, t, g, unknown or other
  modified_base (418)..(418): a, c, t, g, unknown or other
  modified_base (457)..(457): a, c, t, g, unknown or other
  modified_base (489)..(489): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttcttgttgttattttagaaggtgtccagtgtgaggtgcacttggtggagtcgtgggggaggctttgggtccgagggcccggggggggtccctggagaccttctcctgtgcagtctctggattccaccttagaagttatggatgactggtccnccagctcgagggagggntggagtggtgaccaanataaaacgaaagacgaatacaaagaaaaacctatgtagactcgtgtacgaccggccgtattccaccatcaccaganaacaacgaccaataatccatgtaattgaacaaatcgaanagtcagagacgcgagacgacgcgtagtaattntgtgcgacgagatacgtaagtacgtagacttaccgtaaataagtacgacgtaggtagtagtagtagttg

SEQ ID NO: 372503 - DNA, 737 bp, Homo sapiens
  misc_feature: GZ8MTXP02F4B5U.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcgttggtccaggccgggggggtccctgagactctcctgtgcagtctctggattcacccttagaagttattggatgacctgggtcccgccgaggctccgaggggaagggctgggaggtggggtcggaccaaacaataaaacgaaaggaacggaaagtacaaaggaaaaaccctatgtaggacttcgtaggtacggaccgggccgtaattacccaacctagttcctaccgaagaacgaaacccaaacccggacccaaaagtaactttaccaacgttaggtttaattttacggaacctaaaaagttcggaaaaccacggtacccgtagggaaacggacggggaacgggaaacgggaacccgtaaccgggggtacccggttagtttaacgtttaagtttggtacggtacggaccgaaagggtacttaaggggtaaattaagggttaaacgtaacccgttacgtaaacgtaaggttaacggacggtaagggggttaggtaacgttaggtaaccgttttcggg

SEQ ID NO: 372504 - DNA, 649 bp, Homo sapiens
  misc_feature: GZ8MTXP02GCWLJ.15.67.G01.1.454.CMB.2.raw
  modified_base (313)..(313): a, c, t, g, unknown or other
  modified_base (612)..(612): a, c, t, g, unknown or other
tcagtctacgtagccacgaccggtgctcgatttagagtatacatattgggtttgaggtctcagagaggagccttagccctggacttcaaggcctttccacttggtgatcagcactgagcacagaggactcaccatggagttggggctgagctgggttttccttgttgttattttagaaggtgtccagtgtgaggtgcacgttggtggagtcgtgggggagcgttggtccagggccggggggtccctggacgactctcctgtgctagtctcgtggacttccacccttagaagttattggatgaccgtgggcccncgacggcctcgaaggggagggctaggggagtgggtcggaccaaacgtaaataaaacgaaagaacgggaaagtacaaaaggtaaaaaccctgtagtaggactacgtggtacgaccgggcctaattaccgacctagtctaccaaggaacgaaccaaaccgacaaaagtaattcctagtcgttaattgaacaaaagtagaaacacgcctaggagacgggaggaacggaccgacggtccgttaggtaattaggttgcgtcgacgaggtaaactggtaaaatacgtaacgtaccgtctaaacgnggtaaagtcgtaagggggtgttatacgtaggtttacg

SEQ ID NO: 372505 - DNA, 718 bp, Homo sapiens
  misc_feature: GZ8MTXP02GUA15.15.67.G01.1.454.CMB.2.raw
  modified_base (305)..(305): a, c, t, g, unknown or other
tcagtctacgtagccacgaccggtgctcgatttagagtatacatattgggtttgaggtctcagagaggagccttagccctggactcccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctggagactctcctgtgcagtctctggattcacccttagaagttatggatgacctgggtccnccaggctccaggggaagggctggaggtgggtggccaaacataaacaaagaccggaaagtaccaagaaaaaacccctgtagtaggaactcgtagttacggaaccggggccctaatttaccgacccatttcccgtacccaaaggaacgaaccttaaaaccggccccaaaaggtaaacctttccaaaccgttcggtaactttttaggaaccgtttaaaaaacgtaacgaaacctaacggtaccgtaagggaaggaacgggtaccgggaaacggaaccggtaaccgggtaccggtttaaggttaaacgtttagttacgggtacggacggtacggtaacggtagtacggtaaagttaaccggtacgtaaccttacgtaacgaaggtacggacgtacgggtagtaacgtcgtagttacg

SEQ ID NO: 372506 - DNA, 691 bp, Homo sapiens
  misc_feature: GZ8MTXP02JQ0GU.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcgttggtccgagggccggggggtccctggagactctcctgtgcagtctctggacttcacccttagaagttattggatgaccgtgggtcccgcgacggccgtccgaggggaacggggcgtgggaggtggggtcggacccaaaacgaaactaaaacgaaaggaaacggaagtaacgaaagaaaaacgtaagtagtacgtactcgtagtacgaccgggaccgtaacttccaacctactacctaccgacgaacgaaaccgaaacccgaacccaaacgtaaactttacctacttacgttaatttagaactaaaatacgaaacgacgtaccgtaggagaacggacgggaacgacgaccggtacgtacgttagttagttagtcgacgacggagtaagtggtaaacgtaaagtactaaccgttaacgtaacgtaacggtaacgtacggtaagggttaggttacgtacgtagttttacg

SEQ ID NO: 372507 - DNA, 603 bp, Homo sapiens
  misc_feature: GZ8MTXP02I77DJ.15.67.G01.1.454.CMB.2.raw
  modified_base (483)..(483): a, c, t, g, unknown or other
  modified_base (531)..(531): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgcacgttgggtggagtcggtggggggaggtcgtttgggtcccgagggtcccgggggggtccctggagaccttctcctgtgcagtctcgtggattcacccttagaagttagttggagtgaccgtcgggtccgccaggctccgaggggaaggggcgtggaggtggggtggaccaaacaaagtaaaacgaaaggaccggaaagtacaaagaaaaaacctatagtacgaactctggtacgacggcgacgttcaccatctccagagacaacgacaaagacttcactgttatttnacaaatgaacgagcctgagaggcggacgacgacggcgtgtattatggngtcggacgagtatggtattagtacgaactcgtaaacgaacgtaagacgtaggtaggtaactggtactttagg

SEQ ID NO: 372508 - DNA, 760 bp, Homo sapiens
  misc_feature: GZ8MTXP02I04J1.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgtttgtttattttagaaggtgtccagtgtggaggtgcacttgggtggaggtcgtgggggaggcttggtccgagggcccgggggggtccctggacgacttcctccgtgtgcagtcttcgtggacttccacccgttaaggtaagtttaagttggatgaccggtcggtcccgccgaggcgtaccggaggggaaggggcgtgggagggtggggtcggaccaaaacgaataaaaacgaaaggaacggaaagtacaaaagaaaaacgttgtaggtggtacttcgtacggtacgacggggtcccgtaaactttaccaccgacttccctaccgaagaaccgaaaccgaaaccgaccaaagtaaacttcgtaacgttacgttaagtttagaacctaaaagtacgaaaaccgtacggtacccgtaaggaacgggacgggaacgggaacggaaccgtacgggttacggggtaccggtttagttaagttttaggtttggtaccggtggtacgggtagaaggttaaggtaacgttaaggtaacgttaacccgtagttaaaccgaaggtttaaccgacggtaagggttacggttaacgttacggtttaacgg

SEQ ID NO: 372509 - DNA, 687 bp, Homo sapiens
  misc_feature: GZ8MTXP02F2YLV.15.67.G01.1.454.CMB.2.raw
  modified_base (622)..(622): a, c, t, g, unknown or other
  modified_base (645)..(645): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagactcaccatggagttgggctgagcgtggttttccttgttgttattttagaaggtgtccagtgtgaggtgcacttgagtggaggtcgtgggggaggtcgttcggtccgaacgggcccggggggttccctggacgtcttctccgtgtcgctagtctcgtggtacttccacccgtttaagtaagtttagtaggatcggtacccgtcgggtcccgccgaggcctaccggaaggggacggggcgtgggaggttcggggacgaccgaaccaaagtaaaaccgaaaaggaaccggtaaacgtaacgaaaacgtaaaaactgtaggtacggtactccgtaggtacgaaacccgggtccgtaacttccaaccactttaccaccgaaacgacgaaacccaaaccgaccgaaaatacttacactttgttaattacgaaactaaatacgaaacgtagtccagggagacgggacgacggacgaccggtcgtagttaagtgttgacgacgngacgtatgtaaagtacgtaaacncttacgtaagtagtacgaggttaggtacgtagtaggtttacg

SEQ ID NO: 372510 - DNA, 718 bp, Homo sapiens
  misc_feature: GZ8MTXP02HK9PR.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggccgggggggtccctggagactctcctgtgcagtctctggattcacccttagaagttattggatgacctgggtccgccaggctccgaggggaaggggctgggagtggggtggaccaaacaataaaacgaaagaacgggaaagtacgaaagaaaaaaccctagtagtaggaacttcgtaggttacggaaccgggcccgtaatttccaaccctatcctaccagaacgaacaaacccggccaaaagaactttacaacttagttaatttacgaactaaaataggaaacagtccctaggaaggagggacggaaacgggaccgaccgggtacccggttagttaacgtttagtttacggtacggtaccggtacggaaaggtagttaaggaagtttaaaacggttaacggtaaaccctttaccgtaaaaccgaaaggttaacggtaaaccggttacgggggttagggttaaacgtttacggtaacgttttacggg

SEQ ID NO: 372511 - DNA, 583 bp, Homo sapiens
  misc_feature: GZ8MTXP02FFQ32.15.67.G01.1.454.CMB.2.raw
  modified_base (383)..(383): a, c, t, g, unknown or other
  modified_base (391)..(391): a, c, t, g, unknown or other
  modified_base (454)..(454): a, c, t, g, unknown or other
  modified_base (493)..(493): a, c, t, g, unknown or other
  modified_base (516)..(516): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtccagtgtgaggtgcacgtttggtggagtcgtggggggaggtcttgggtccgacgggccggggggggttccctggacgacttctcctgtgcagtctctggacttcaccttagtagttatggatgacctggccgcaggctcgaggggagggctggaggtggtggaccaaacataaacgaaagcgaagtacaaagaaaaacctntgagactngtacgacgcgattcacctatctaccagacactaaccgactaaagaactcactggttactttanagaaacttgaaacgagcctaggagacggacgaggtaccncggggtacttggtaaattctgtncggacaggactagaattagggactacctacgtaccgaagtagacgtagggtacgtagtagactttgg

SEQ ID NO: 372512 - DNA, 748 bp, Homo sapiens
  misc_feature: GZ8MTXP02IX8DY.15.67.G01.1.454.CMB.2.raw
  modified_base (298)..(298): a, c, t, g, unknown or other
  modified_base (302)..(302): a, c, t, g, unknown or other
  modified_base (314)..(314): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgctacgttggtggagtcgtgggggaggtcttggtccgagggcccgggggggtccctggacgactctcctagtgcagtctcgtggacttctaccttagaagttntggntgaccgtggccncaggctccggaggggagggctaggggaggtggggtcggaccaaacagtaaaacgaaaggaaccggaagtacgaaaagaaaaacctgtaggtacggacctagtggtacgacggggtcctaacttaccacctattccgacccaaaggacaaacgaaaccggtaccctaaaaggtaacttacacgtttaggttaattttacggaacctaaaagtacgaaaacgacgttacccgtagggaacgggaacgggacgggaaacgggttaacccgaaccgggggttcgtttaagtttaaacgtttaggtttgggtacggaaccgggacaagggtattacggggtaaacttaacggggttaagtaaccttaaccgttaacggaacggtttaaacggggtacggttaacggggttacggttacggttacggtttacgtttacgg

SEQ ID NO: 372513 - DNA, 751 bp, Homo sapiens
  misc_feature: GZ8MTXP02FMPEP.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtggaggtgctacgttgggtggagtcggtgggggaggtcgttgggtccgagggcccgggggggttccctggacgaccttctcctgtgctagtctcgtggattcacccttagtaagttattggatcgaccgtggtcccgccgaggccgtccgaggggaacggggcgtgggaggtggggtcggaccaaaacgaagtaaaaacgaaaaggaacgggaaagtaccgaaaagtaaaaaacccgtagtcggtagggtaccttcgtaggtacgggaaccggggacccggaatttacccgaaaccctaacttccgttaaaccccgaaaggaaaccgaaaccgaaaaccggccctaaaaccggtaaaacgttaacttaacgtaacgtttagttttaaaggttaccaaaagtaacgtaaaacgaccgaacccgtcgggagaagggggacggaacgggaacggaacgggacccggtgttacgttagtttagtcgggacgcggagagtacgtagtaacgttaagacgtacttaacgaagtacggtacggtaggtaggttagtagtaggtttacg

SEQ ID NO: 372514 - DNA, 1080 bp, Homo sapiens
  misc_feature: GZ8MTXP02FSE1E.15.67.G01.1.454.CMB.2.raw
tcagtctacgtagccacgaccggtgctcgatttagagtatacatattgggttttgaggtctcagagaggagccttagccctggactccaaggcctttccacttggtgatcagcactgagcacagaggactcaccagtggaggttggggctgagtcgttgggtttttccttgttgtttattttagaaggtgtcagtgtgaggtgctacgttggtggagtcggtggggggaggtcgtttcgggtccgacggggtcccggggggggttccctaggacgtaccttccgtccgtggtcgctacgttccgttcgtggtactttaccaaccccgtttaagaaacggtttaattgggtacgtaggaccccgtttggggcccccgaccgaacggtccgtacccggaagggggaaacggggtcgttaggggtaggttagggggtaccgggtaaaccccaaaaaccgaaaagttaaaaaacccggaaaaacggggtaaaccggggtaaaacggttaaaccggaaaaaaacgggttaaaaaaaacccccgttagggttttaaccggggtaacgggttaacccgttttacgggtttaacccggggttaaaggggtaaaccccccggggttccggggtaaaacctttttaaccgaaaaccccccgttaaaccgttttaacccgaacccccggaaacgggtaaaacccgaaaccccggaaaaacccgggtaaacccccgtaaaaaaaggtttaaccctttaaacccgttaaaccggttaggtttttaaaacttttccgggaaaaaccttaaaaacgtttaaaccggaaaaaccgtaaaccgggtaccgttaacgggaaacggggtaaaccgggggaaccggggtaaacggggaaaccccgacccgggggtttaccgggttaattttaaggtttaaacggggttcttacgggggaccggttacggaaaaggtaaagtttaacggtaaaagtaacggtttaaccgggtaaaccttaacggttaaaacccgttaaaagggtgggtaaaccggtaagggggttttaggtaaaggtttaccggtaagttttttacggggg

SEQ ID NO: 372515 - DNA, 571 bp, Homo sapiens
  misc_feature: GZ8MTXP02FVEN2.15.67.G01.1.454.CMB.2.raw
  modified_base (521)..(521): a, c, t, g, unknown or other
  modified_base (563)..(563): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccggggggggtccctgagactctcctgtgcagtctctggattcacccttagaagttattggatgacctgggtccgccaggctccgaggggaggggctggagtgggtggccaacataaacgaaagacggaagtcaaagaaaacctatcgtaggactagtgtaggacggcgattcacctatctcagacgacaaccgaccaaagtaacttacactgttactttagacaaaagttgaaacaggcctagagaacgggcggaacggacgacggcgttaggttattagttgtgacgngaggattggatacgtacgactctagaagtagcgtaggtgtanggacttgg

SEQ ID NO: 372516 - DNA, 676 bp, Homo sapiens
  misc_feature: GZ8MTXP02I58KH.15.67.G01.1.454.CMB.2.raw
  modified_base (618)..(618): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggaggtcggtgggggaggtcgtttcgggtccgaggggtccccgggggggttccctggacgtaccttcctccgtgtcgctaggtctcgtggattcacccttagagtttagttggatgaccgtcgggtcccgccgaggctccgaggggaacgggcgtgggaggtggggtcggcccaaacgaaagtaaaacgaaaaggaacggggaaacgtaacgaaacgtaaaaaccctgtaggtaggacttcgtaggtacggaccggggccgtaatttcccaaccctacttcctacccgaaaggacgaaacccaaacgtaacccaaagtaacttacacttagttagtttgaactaaatcgaaacacgcctaggaggaggcggaggaccgacggccgttaggtattattcggtgaccggataggntacggaatacgtacgtacctacgtacgaagtaagtcgtagggtggtatacgagtttcg

SEQ ID NO: 372517 - DNA, 559 bp, Homo sapiens
  misc_feature: GZ8MTXP02IROY5.15.67.G01.1.454.CMB.2.raw
  modified_base (513)..(513): a, c, t, g, unknown or other
  modified_base (529)..(529): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttgggtggaggtcgtggggggaggcttggtccaggcccgggggggtccctgagactctcctgtgcagtctctggattcacccttagaagttattggatgaccgtgggtccgccaggctcagggaaggggctggagtgggtgccaacataaacaaagacggaagtacaagaaaaacctatgtaggactcgtgtagacgggccgattcaccatctccaagagacaacgaccaagaattcgactgttatttgaacaaatagaacaagcctagagaggcgtaaggacacggccgtagtattagttagtgcgacgaganggtaatagtagacctnacgtaagtgacgtaggtaggtatgactttg

SEQ ID NO: 372518 - DNA, 667 bp, Homo sapiens
  misc_feature: GZ8MTXP02GZ4D6.15.67.G01.1.454.CMB.2.raw
  modified_base (333)..(333): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagactcaccatggagttggggctgagctgggttttccttgttgttattttagaaggtgtccagtgtgagtgcacttggtggagtcgtggggagcgttggccgaggtcccggggggtccctgagacctctccgtgtgcagtctcgtggattccaccttagagttatggatgacctggtccgcagcgtccgaggggacggcgtggagtgggngaccaactaaagtaaaacgaaaggaacggaagtacaaagaaaaaaccctgtacgtacgacttcgtagtacggaccggtccgaacgtttccaacccattccgtaaccgaaggaacgacctaaaccgaccctaaaaggtaactttaccgaacgttagttaacgtttagaaaccgtaaagttacgaaacgacgtacccgtaggaacgacgggacggtaacgacgaccggtacggtttagtaacgtttagtcgtgccgtaggacgtagtacgtaacgaagttacgacttaccgaagtaacggttagaacgtagggttagttagtacggtagtttacgg

SEQ ID NO: 372519 - DNA, 810 bp, Homo sapiens
  misc_feature: GZ8MTXP02F1EKV.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttattttagaaggtgtccagtgtgaggtgcacgttggtggagtcggtgggggagcgttgggtccgacgggcccggggggtccctggacgactctcctgtgcagtctcgtggtacttccacccgttaagaagttatggatgaccgtgggtcccgaccgaggcctaccgagggggacgggcgtgggaggtcggggtcggacccaaaacgaagtaaaaacgaaaggacggaaagtaaccaaaagtaaaaaccctgtaggtacggaacttcgtggtacgaaccggggtcctaacttccaaacccgtattccgtaccgaaaggtaaacgaaaccgaaaccgtacccaaaaggtaactttacccgtattaggtttaacttttacgggaaccgtaaaagttacgaaaaccgacgggttccctaaagggaacggggaacgggaaccgggtaaacggggaaccccgtaaccgggggtcccgtttaaggtttaaaacggtttagtttcgggtacgggttaccccggaacggtaaggggtaacttaacgggaaggtttaaacggtaaacgtacccgttacccggtaaaaggtaagttaaaaccggaccgggttaaggggttacggttaaacggtttacggaaagtttttccggg

SEQ ID NO: 372520 - DNA, 660 bp, Homo sapiens
  misc_feature: GZ8MTXP02IRED2.15.67.G01.1.454.CMB.2.raw
  modified_base (255)..(256): a, c, t, g, unknown or other
  modified_base (283)..(284): a, c, t, g, unknown or other
  modified_base (295)..(295): a, c, t, g, unknown or other
  modified_base (591)..(591): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaggtgtccagtgtgagtgcacttggtggagtcgtgggggaggcttggtccaggccggggggtcctgagactctcctgtgnngtctctgattcaccttagagttatggnngctcgggtccncagactcgaggggaaggctggagtgggtgaccaacaataaacaaagacggaagtacaaagaaaaacctgtagtggaactcgtagtacggaccgggtcgtattacccgaacctacctctaaccgagaaacgacgaaaccgccaaaagtacttacaacgtttgtaacgttttagactaaaagtacgaaacctaacggtccgttacgggaaggacggggtaccgggaacgggtaaacccggtaccggggtacccgttaggttaactttaggttacggttcggacgtacggaggttagtntaaaacggtaggtaactccgtacttaaaccgtaagtacgacgttagggtagggtattacggtaatttgg

SEQ ID NO: 372521 - DNA, 617 bp, Homo sapiens
  misc_feature: GZ8MTXP02H0EDU.15.67.G01.1.454.CMB.2.raw
  modified_base (384)..(384): a, c, t, g, unknown or other
  modified_base (488)..(488): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgttgggttttccttgttgttatttagaaggtgtccagtgtgaggtgcacgttggtggagtcgtgggggaggtcgttggtccgaggcccggggggtccctgagctctcctgtgcagtctcgtggacttcacccttagaagtttattggatcgacctgggtcccgccaggctccgaggggagggctgggagtgggtggccaaacataaacaaagacgaagtacaagaaaaacctngtggactcgtggtcgacggccgtaattccaaccctatcctacagacaacaacgtaccaaagattacgacttagtatttagacaaatgaaacagccgtggaaggnggacggacggacgtaccggccgttagtagtttaatggtagccgtaggagtagtagtagttaaccgtaagtacgttacccgttaacgaaggtagtaccggtagggttacggtaacgttcgtaagtttcgg

SEQ ID NO: 372522 - DNA, 775 bp, Homo sapiens
  misc_feature: GZ8MTXP02IKWJK.15.67.G01.1.454.CMB.2.raw
  modified_base (748)..(748): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggaggttgggctgagtcgttgggttttccttgtttgtttattttagaaggtgtccagtgtgaggtgctacgttgggtggtaggttcggtgggggtaggtcgtttcgggtcccggacggggtccccgggggggttccctgggaacgtaccgttccgttccgttggttcgcgtagttccgtcgttggtaactttccgtaaccctttaggaaagtttaattgggatacggaccgttcggggtcccgcccgaggcctccggaaggggtaacggggctaggggaggtaggggtcggacccctaaaacgtaagtaaaaaccgaaaggaaccggtaaagtaacgaaaacgtaaaaaaccctagtaggtacggaccttacgtaggttacggaaccggggtcctaaattccccaaacccgtactcctaaccgaagaacgaacaaaccgacgaaaatacttaacattagtttattagaacctaaaagtacgaaactacgtaccgtaggaaacggacggacggaacgaccggtaaccgggtaccgttagttaaactttgggtacgtaggaccgtacgagtaagttacgtaaagtaacgtacgtaaacttacgaataagttacgnggttacggtagtacgtagtactttagg

SEQ ID NO: 372523 - DNA, 627 bp, Homo sapiens
  misc_feature: GZ8MTXP02G4X4M.15.67.G01.1.454.CMB.2.raw
  modified_base (303)..(303): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcttggtccgaggcccgggggggtccctgagactctcctgtgcagtctctggattcaccttagagttatgatgacctggtccncagctccgaggggagggctggagtggggtcgaccaacaataaaacgaaaggaacggaagtacaaagaaaaaccctagtagtaggactctaggtagaccgggtccgactttccgaaccacgtacctacccgaagacgaaccaaaccgtacaaagtaacttacactagtatttacaacgaaatacgaaacacgccgtaggaagaggacggaaggacgaccggtaccgtaggttacttaagttgtaggtccgacggtagatagattaacgggtactacgacgttaccgaaggtacgacggtaaggtgggtacttaggacgtttaagg

SEQ ID NO: 372524 - DNA, 903 bp, Homo sapiens
  misc_feature: GZ8MTXP02FTSLV.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagagactcaccatggagttgggctgagcttggttttccttgttgtttatttagaaggtgtccagtgtgaggtgctacgttggtggtaggttcggtgggggaggtcgtttcgggtccgacggggtcccgggggggttccccgtggacggtacttccttccgtgtgctagtcttcgtggtactttacctacccgttaagtaagttagttggagtcggtacccggttcggggtccccgtaccgacggccgttaccgggaaagggggacggggtcggtaggggtagggtggggtaccggaacccgtaaaactaaagtaaaaaccggaaaagggtaaaccggaaagtaacgaaaaaggtaaaaaaccctaggttaggtacggtacttacgttacggtaacgggtaaccggggtcccgtaaactttaccaaaccccgtacttacccgtaaccgaaacgggaaaacctaaaacccggaaacccgaaacccggtaaaagttaaacccttttacccgtaaagtttacgttttaaaacgtttacgtaaaacgtaaaaacgttcgaaaaaccgtccgaacccgttaggggaaacggacgggtaaccgggggaaacgggaacccgttacccggggtacggtttagtttaaacgtttaggttggtaccgggccgggtaaacgtagggtacgttaacggtaaagtttaaacggttaaccggtaaccttaccgtaaacggtaacggttacgggaacggtttagggggtaaggtttacggtaacgtttaggtttacgg

SEQ ID NO: 372525 - DNA, 565 bp, Homo sapiens
  misc_feature: GZ8MTXP02F3JI7.15.67.G01.1.454.CMB.2.raw
  modified_base (342)..(342): a, c, t, g, unknown or other
  modified_base (374)..(374): a, c, t, g, unknown or other
  modified_base (536)..(536): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccaggccgggggggtccctgagactctcctgtgcagtctctggattcacccttagagttattggatgacctgggtccgccaggctccgaggggagggctgggagtgggtgccaanataaacaaagacggaagtacaagaaaaacctntgtaggactcgtgtacgacggccgattcaccatctccagacgacaacgccaaagaattcactgttactttgacaaatgaaacagccgtagaggagggacggaaggaccgacgggaccgtgttattagttgtggccgcgagagtgaatagtacgactcgtaanaagggtacacgagggtggtactgagtttg

SEQ ID NO: 372526 - DNA, 602 bp, Homo sapiens
  misc_feature: GZ8MTXP02FK5GX.15.67.G01.1.454.CMB.2.raw
  modified_base (345)..(345): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgagggcccgggggggtccctggagactctcctgtgcagtctctggattcacccttagagttatggatgacctggtccgcaggctccgaggggaagggctggagtgggtggaccaaanataaaacaaagacggaaagtcaaagaaaaacctatagtaggactctgtagaccgggccattccaaccatactccaagacgaacaaacggccaaaagacttacactgtatttagacaaaatgaaaacacgcctaggagaggacggaaggtacccgacggaccgtagttaacttaagttgtggacgacggaatagttagaattaaggaacgtacctacttaaacgaagtacgacgagggttagtaactggtaactttgg

SEQ ID NO: 372527 - DNA, 569 bp, Homo sapiens
  misc_feature: GZ8MTXP02FOZWB.15.67.G01.1.454.CMB.2.raw
  modified_base (384)..(384): a, c, t, g, unknown or other
  modified_base (517)..(517): a, c, t, g, unknown or other
  modified_base (550)..(550): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccgggggggtccctgagactctcctgtgcagtctctggattcaacccttagaagttattggatgacctggtccgccaggctccgagggaaggggctggagtggggtggaccaaacgataaaaccaaaggaaccggaagtacaagaaaaaccctntgacggtactctgtagaccggccgattcaccatctaccagacgacaaaccgaccaaagaattccaactgtaatttgacaaagtgaaacagtccaggagaggcggaaggcgaaccggcgtgttacgtagtttgngcgacgagagtgaactgagactcaaatcgacgngacggtgtatcggtattag

SEQ ID NO: 372528 - DNA, 581 bp, Homo sapiens
  misc_feature: GZ8MTXP02FHQ4W.15.67.G01.1.454.CMB.2.raw
  modified_base (390)..(390): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggcttggtccaggccgggggggtccctgagactctcctgtgcagtctctggattcacccttagaagttatggatgacctggtccgccaggctccgaggggaagggcgtgggagtggggtggaccctaaacgaataaaacaaaaggaacggaaagtacgaaagaaaaaaccctntagtaggactctgtaggaccgccgaattcaccatctccaagagaacaacgacccaaagaacttcactgttaatttgacaaaatgaaacagcctagacgaggacgagaccgaggctggtacttatgtgccgtgagagtcgaatacgacgtaactctaacaaggttaacgactagggtaggtataggacttgg

SEQ ID NO: 372529 - DNA, 771 bp, Homo sapiens
  misc_feature: GZ8MTXP02F64HT.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgttatttagaaggtgtccagtgtgaggtgcacgttggtggagtcggtgggggaggtcgttgggtcccgacgggtcccgggggggtccctggagtacctctccgtgtcgctagtctcgtggtattcctaccttagtaagttaattggatcgacctcgggtccgccgaggcgtccgaggggtaaggggctggggaggtgggtcggaccaaaacaagtaaaaccgaaaaggaacgggaaagtacaaaagtaaaaacccttagtagtaggtacttcgtagtacgggaaccgggtccgtaacttaccgacctacttccgtaccgaagaacgaaaccgtaaaccgaacccgtaaaagtaactttacaaccgttagtttaatttacggaactaaaagttagaaaacgtacgaccgttaaggaacggtaaggaccgggaaacggaaccgtaccggggaccgtttaagttaacgtttaaaggttgttacgggtaccgtacggaaaggttagtaacggtaaagttaaccggttaaaggaaccttaaccgttacggtaaacggtaaacggtacggttaggggtttaacggtacgttaaggtaccgtttttaacggg

SEQ ID NO: 372530 - DNA, 670 bp, Homo sapiens
  misc_feature: GZ8MTXP02JPP12.15.67.G01.1.454.CMB.2.raw
  modified_base (317)..(317): a, c, t, g, unknown or other
  modified_base (553)..(553): a, c, t, g, unknown or other
  modified_base (626)..(626): a, c, t, g, unknown or other
  modified_base (634)..(634): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagactcaccatggagttgggctgagcgttggttttccttgttgtttattttagaaggtgtccagtgtgaggtgcacgttggtggagtcggtgggggaggtcgttggtccgagggtcccgggggtcctgagctctcctgtgcagtctcgtcggtattcctaccgtaagtaagttatggatcgaccgtcgggtccncacggctccggaaggggacgggtcgtaggaggtcgggtacgacccaaaataaacgtaaaagaaacggaaacggtaagtaaacgaaaataaaaacccgttgtaggtacgacttacgtacggtaacggaccggggtacctaacttccgaaaccacttaccgtacgaacgaacgaaacgaaacccgaactaaaacgtacttactacgttattacgtttagaaactaaagagtaaacgcnctagggacgaggaccggtaagaccgtacggcgttattattaaggtctagacgagtagagtagacgtaaggtanaaccgttnaaagtaagtacggagttacgggatataggatttccg

SEQ ID NO: 372531 - DNA, 715 bp, Homo sapiens
  misc_feature: GZ8MTXP02IV9F6.15.67.G01.1.454.CMB.2.raw
tcagtctacgtagccacgaccggtgctcgatttagagtatacatattgggtttggggtctcagagaggagccttagccctggactccaaggcctttccacttggtgatcagcactgagcacagaggactcaccatggagttggggctgagctgggttttccttgttgttattttagaaggtgtccagtgtgaggtgctacgttgggtgggagtcgtggggggagtcgtttgggtccgacgggcccgggggggttccctggagtaccttcctccgtggtgctagttctcgtaggtacttcacccttagaagtttagttggatcggaccgtcgggtcccgccacggcctccggaaggggaggggtctaggggaggtggggtcggaccaaactaaataaaacgaaaaggaccggaaagtaccgaaaagtaaaaacctgtagtggtaccgttgtacggtacgaaccgggtccggtattacccacctatccctaccgaggaccgaaacgacgactaaacgaacttcgtaacttagttatttgaaactaaagtacgaacacggtaccgtaggaaggcggaacgggacgggaaaccgtccggggacctttagggttatttaaggttcggttacggacggacgttaaggatttaggaacgttaaggtactaccgttactacggtaagtaacggagtaggttacgtaagtcgtagtacgttttg

SEQ ID NO: 372532 - DNA, 546 bp, Homo sapiens
  misc_feature: GZ8MTXP02I4BIX.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctctgtgcagtctctggattcacccttagaagttattggatgacctgggtccgccaggctccgaggggaaggggctgggaggtggggtggccaacataaacgaaagacggaaagtcaaagaaaacctatgtagctcgtgtggacggccgattcaccatctccagagacaacgcaagatcactgtatttgacaaatgaaacagcctaggagaggcgagacgacggcgtagtatattgtgcgtcgagatgtatacgtagacttacacgaagttcgacgtaggtgtagtcggatttgg

SEQ ID NO: 372533 - DNA, 784 bp, Homo sapiens
  misc_feature: GZ8MTXP02HOAGO.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggaggttgggctgagcttgggttttccttgttgttatttagaggtgtccagtgtgaggtgctacgttgggtggaggtcggtgggggaggtcgttcgggtccgacggggtcccgggggggtccctggacgtaccttctcctgtgctagtctcgtggtacttccaccttagaagttagttggatggaccgtgggtcccgaccgaggtcctaccggagggggaacggggctaggggaggtggggtcggacccaaaagtaacgtaaaaacgaaaaggaacgggtaaagtacgaaaagtaaaaaaccctagtacggtggacttcgtaggttacggacccgggtccgtaaattacccaaccctacgttccctaccgaaagggaaaccgaaacccgaaacccggaaccctaaagtaaactttacccaacgtttagtttaaacttagtaacctaaaagttacgaaaccgaccggtaccgttagggaagggacgggaacgggtaacgggaaccgtaccggggtaccgttaggtttaacgtttagttcgggtacgccggtacggtaaagtagtacggtaaagttacgggtaaacgttacctaaccgtaacgtaaggttacggaacggttaggggttaagtagttacggttaagtttcgg

SEQ ID NO: 372534 - DNA, 536 bp, Homo sapiens
  misc_feature: GZ8MTXP02FTTHP.15.67.G01.1.454.CMB.2.raw
  modified_base (305)..(305): a, c, t, g, unknown or other
  modified_base (365)..(365): a, c, t, g, unknown or other
  modified_base (368)..(368): a, c, t, g, unknown or other
  modified_base (402)..(402): a, c, t, g, unknown or other
  modified_base (467)..(467): a, c, t, g, unknown or other
  modified_base (486)..(486): a, c, t, g, unknown or other
  modified_base (514)..(514): a, c, t, g, unknown or other
  modified_base (530)..(530): a, c, t, g, unknown or other
tcagtctacgtagccacgaccggtgctcgatttagagtatacatattgggtttgagggtctcagagaggagccttagcccctggactccaaggcctttccacttggtgatcagcactgagcacagaggactcaccatggagttggggctgagctgggttttccttgttgttattttagaaggtgtccagtgtgaggtgcacttggtggagtctgggggagcttgggtccaggccggggggggtccctggagactctcctgtgcagtctctggattcacccttagagttatggatgactgggtccncaggctccagggaggggctggagtgggtgcaacataaacaaagacgatacagaaaacctntgnggtactctgacgacggcgattcgaccatctccanagacaacgtccaaagattcactgtattgacaaatgaaacagacctaggagagggacgaggacccngggaccgtgttaatattgngcgtcgagatgaatgtacgctacgtacngttagctaggtgtagngtactg

SEQ ID NO: 372535 - DNA, 612 bp, Homo sapiens
  misc_feature: GZ8MTXP02G153L.15.67.G01.1.454.CMB.2.raw
  modified_base (270)..(270): a, c, t, g, unknown or other
  modified_base (287)..(287): a, c, t, g, unknown or other
  modified_base (305)..(305): a, c, t, g, unknown or other
  modified_base (324)..(324): a, c, t, g, unknown or other
  modified_base (409)..(409): a, c, t, g, unknown or other
  modified_base (544)..(544): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggtcttgggtccgaggcccggggggtccctgagactctcctgtgctgtctnggattcaccttagattntggatgaccgtggtcccncagctaccgaggggaggcnggagtgggtgaccaacaataaacgaaaggacggaatcgaaagaaaacctgtagtcggactctaggtacgaccgccgattccaccnttccacaagtacgaacaaccgaccaaagtaacttacacttaggttatttacgaactaaaaggtacaaactaacgcgtaggagaggaccgaaggtccgacggtccgttaggttacttagtcggtcggacgacggtnaagtacgaaagttagacgtaaactcgttaaaccaaggtaacggacgtagggtggtaatgtaagtttcg

SEQ ID NO: 372536 - DNA, 808 bp, Homo sapiens
  misc_feature: GZ8MTXP02JSMZL.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagtcgttgggttttccttgttgtttattttagaaggtgtccagtgtgaggtgctacgttggtggagtcggtgggggaggtcgtttcgggtccgacggggtccccgggggggttccctaggacgtaccgttccgttccgttggtcggtactacggttcttacgttagggtacttaccctaacccgtttaaggtaaaggttttacgttagggtatttaccgggtacccgttcggggttccccgaccgtaacggccgttacccggaaggggggtaacggggtcgtaggggtacggtggggtacgaacccaaaacgtaaacgtaaaaacgaaacggaaaccgggtaaacgtacgaaaagtaaaaacccgttgtacggtacggtacttcggtaggttaccggaccggtaccgtaactttaccgaacctagttacccgtacgaaggtaaccgaacctaaacccggactaaagtacttactacgttagttactttagaaccaaagttaacgaacgtcgtaccgtagggacgtacgggaccggaaggacccgtacgggtacgttagtactttagttgaacgccggtaaacgtagtacgttaggaacttaacggtaccgtacgttactaaagtcggtaatacgggtaggtagtacgtagtacgtttacg

SEQ ID NO: 372537 - DNA, 586 bp, Homo sapiens
  misc_feature: GZ8MTXP02GGBAL.15.67.G01.1.454.CMB.2.raw
  modified_base (266)..(266): a, c, t, g, unknown or other
  modified_base (271)..(271): a, c, t, g, unknown or other
  modified_base (313)..(313): a, c, t, g, unknown or other
  modified_base (427)..(427): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcgttgggtccgagggccggggggtccctggagactctcctgtgcngtctntggattccacccttagtaagttattggatgaccgtgggtccnccgaggctccgaggggagggctggaggtggggtcggaccaaacataaaacgaaagacggaagtacaaagaaaacctgtgtagactgtagagacgcgattcacctatctacaganaacaacgaccaaagacttcactgtattacgactaaatagaaacgagcctagaggacggacggaaggaaccgaccggtacgtagttattagtgtcgcgacgagtatagaaagttagtacgtacgtcaacgtaagtagacgtaggtagtatggtatttcgg

SEQ ID NO: 372538 - DNA, 658 bp, Homo sapiens
  misc_feature: GZ8MTXP02IAY4S.15.67.G01.1.454.CMB.2.raw
  modified_base (321)..(321): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttcttgttgttattttagaaggtgtccagtgtgaggtgcacttgggtggagtcgtgggggaggcgttggtccgagggcccggggggggtccctggacgactcgtcctgtgctagtctcgtggacttccaccgttagaacgtttatggatcgaccgtcgggtccnccgacggctaccggagggggaagggcgtggggacggtggggtacgacccaaaagaaataaaacgaaaggacggaaacgtacaaagtaaaaacctagtggtagactgtaggacgacgtccgattaccgaccatccctacagaacaaccacgaccaaagtaactctaacgttgttaatttcgaactaaagtacgaaacgcgacccgtggaacgagggacgaacggacgaccggtacgttagtatttagtgtcgacgacggagtagtagtagtaacgtacgtacttaccggaactaacggtagtaacggtaggggttacgtacggtacgtaccgtttagg

SEQ ID NO: 372539 - DNA, 603 bp, Homo sapiens
  misc_feature: GZ8MTXP02JUHIH.15.67.G01.1.454.CMB.2.raw
  modified_base (392)..(392): a, c, t, g, unknown or other
  modified_base (432)..(432): a, c, t, g, unknown or other
  modified_base (480)..(480): a, c, t, g, unknown or other
tcagtctacgtagccacgaccggtgctcgatttagagtatacatattgggttttgaggtctcagagaggagccttagcccctggactccaaggccctttccacttggtgatcagcactgagcacagaggactcaccatggagttggggctgagctgggttttccttgtgttattttagaaggtgtccagtgtgaggtgcacttggtggagtctgggggaggcttggtccaggccgggggggtccctgagactctcctgtgcagtctctggattcaccttagagttatcggatgacctgggtccgaccaggtctccgaggggaaggggtctggagtggggtaggccaaacgaataaaaccgaaaggaccggtaagtccaagaaaaaacccgtntacgtaggacctgtaggagaccggccggttaatccaaccngtcaccagacgaacacggaccaaggtactcccatggtaatttccgaanaatagaagagacgaggagaggacggacggacgacggcgtagtagtagtagtcgcgacgagagtacgtagtacgtacgtacgtacgtacgtaagtacgtacgtacgtaggtacgtacgtacgtg

SEQ ID NO: 372540 - DNA, 582 bp, Homo sapiens
  misc_feature: GZ8MTXP02IH8W5.15.67.G01.1.454.CMB.2.raw
  modified_base (451)..(451): a, c, t, g, unknown or other
  modified_base (527)..(527): a, c, t, g, unknown or other
  modified_base (550)..(550): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttatttagaaggtgtccagtgtgaggtgcacttggtggagtcgtgggggaggcgttggtccgaggcccgggggggtccctggagactctcctgtgcagtctctggattcacccttagaagttattggatgacctggtccgccaggctccgaggggaaggggctggaggtgggtggccaaacaataaaacaaagacggaaagtacaaagaaaaaacctagtagtaggactcgtgtagacggccgaattccaccatctaccagagacaacgacaagaattcactntatttgataaatagaaacagcctagaagaggacgaggacacggaccgtagtactttaagtgtagcggcgaaggtanagaattagtaagtacctacctanaagtacgacggtaggtaggtataggtaattgg

SEQ ID NO: 372541 - DNA, 562 bp, Homo sapiens
  misc_feature: GZ8MTXP02GQG4P.15.67.G01.1.454.CMB.2.raw
  modified_base (381)..(381): a, c, t, g, unknown or other
  modified_base (463)..(463): a, c, t, g, unknown or other
  modified_base (505)..(505): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggccgggggggtccctgagactctcctgtgctagtctctggattccaccttagagttatggatgacctggtccgccagctccgaggggagggctgggagtggggtgaccaaacaataaaacgaaagacggaataccaaaagaaaaaccctntagtaggacctgtggtagacgggccaattccacctatactaccagagaccaaacgcaaagaatcatgtattgacaatacaanagcctagagacggagaggacgcggaccgtgtaattattcggngacgacgagagtacgatagtactactatacgaagtagacgtaggtgtagtgtagtcg

SEQ ID NO: 372542 - DNA, 623 bp, Homo sapiens
  misc_feature: GZ8MTXP02G4F8M.15.67.G01.1.454.CMB.2.raw
  modified_base (262)..(262): a, c, t, g, unknown or other
  modified_base (269)..(269): a, c, t, g, unknown or other
  modified_base (329)..(329): a, c, t, g, unknown or other
  modified_base (390)..(390): a, c, t, g, unknown or other
  modified_base (473)..(473): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagtcgttggtccagggcccggggggtccctgagctctcctgtgcngtctcgnggacttcacccttagaattatggatcgactgggtccgccaggctccggaggggagggtcngggaggtcgggtggaccaaacgaataaaacgaaaggacggaatacaaaggtaaaaacctgngttacggacttctaggtacgaccggtcgtacttacaccctgtactaccgagaacactaaccaccgtaaataactcctacgttntttaactttaacaactaaactacgaactacgtacgtaggacgacggacggtaagaccggacggtagtagttagttgtgcgtagacgagagtagtagtaagtacgtacgtactacgtaagtacgtacggtacggtaggtagtacgtagttg

SEQ ID NO: 372543 - DNA, 619 bp, Homo sapiens
  misc_feature: GZ8MTXP02FTMHO.15.67.G01.1.454.CMB.2.raw
  modified_base (203)..(203): a, c, t, g, unknown or other
  modified_base (265)..(265): a, c, t, g, unknown or other
  modified_base (380)..(380): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcattggnggagtcgtgggggaggcttggtccagggccggggggtccctgagactctcctgtgcagtctntggattcacccttagagttattggatgacctggtccgccaggctccgaggggaggggtctggaggtgggtggccaaaacgataaaacgaaagacggaagtacaaagaaaaacctntagaggtactcgtggtacgaccgggcattaccgaccagtctaccgagaagacaacggaccaaagaacttcaactgtttaacgtttgactaaaagtacgtaaacaaccggtacctaggaaggacgggacggaaggtaaccgaacggggccggttaggtttaattagttaggtcgcggtacgagagtagtatacggtaacgtactctaacgaagtacgacgagggttagatagtacgttag

SEQ ID NO: 372544 - DNA, 776 bp, Homo sapiens
  misc_feature: GZ8MTXP02FOHXB.15.67.G01.1.454.CMB.2.raw
  modified_base (186)..(186): a, c, t, g, unknown or other
  modified_base (264)..(264): a, c, t, g, unknown or other
tcagtctacgtagccacgaccggtgctcgatttagagtatacatattgggtttgaggtctcagagaggagccttagccctggactccaaggccctttccacttggtgatcagcactgagcacagaggactcaccatggaggttggggctgagcttgggttttccttgttgtttattttagaaggtntccagtgtgaggtgcagttggtggagtcgtgggggagtcttggtccgagggccggggggtccctgacgactctctgtncagtctcgtggtacttcctaccttagtaagttagttggatcggtaccgttcgggcccgaccgaggccgttaccggaggggggtaacggggcgtaggggaggttggggtacggacccaaaacgtaaacgtaaaaaccggaaaagggtaacccgggaaagttaaaccgaaaaggtaaaaaaccgttgtaggtacggtaccttcggtaggttacggaaccggggtccaacgtttccgaaacccgtattaccctaccgaaacgaacgaacgaaacccgtaccaaaagtaactttacgtacgttcggttaatttacgaacctaaaagttaccgaaaagtaccgaccgtagggacggacgggaaccgggaacggttaaccggaccggtacccggggtttattaaaccgtttagttacggggagtaccggtacgtaagtaggtaacgtaaaggtaacggttagtaaccgtagtaacgtaacggtacggtacggttacggttagtagttagtagtttacg

SEQ ID NO: 372545 - DNA, 598 bp, Homo sapiens
  misc_feature: GZ8MTXP02J3SA6.15.67.G01.1.454.CMB.2.raw
  modified_base (339)..(339): a, c, t, g, unknown or other
  modified_base (466)..(466): a, c, t, g, unknown or other
  modified_base (486)..(486): a, c, t, g, unknown or other
  modified_base (491)..(491): a, c, t, g, unknown or other
  modified_base (493)..(493): a, c, t, g, unknown or other
  modified_base (498)..(498): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctgggggaggctttggtccaggccgggggggtccctgagactctcctgtgcagtctcgtggattcacccttagaagttattggatgaccgtgggtccgccaggctccgaggggaagggtcaggagtgggngaccaaacataaaacaaaggtacggaaagtcaaagaaaaaccctgtgtcggaactctacggtagaccgggccgtaaacttccaccgatcctaccaaagacgaaaccaacgaccctaaagtaaacttnacgtgtaatttgaactaaancgaananaccgngaacgaggccggtaaggaccacggccgtagtagttattggcgacggcgaagatggaataccgtagactacctacgaagtaagcgaggtagtatagacttg

SEQ ID NO: 372546 - DNA, 557 bp, Homo sapiens
  misc_feature: GZ8MTXP02GC9Y1.15.67.G01.1.454.CMB.2.raw
  modified_base (305)..(305): a, c, t, g, unknown or other
  modified_base (393)..(393): a, c, t, g, unknown or other
  modified_base (415)..(415): a, c, t, g, unknown or other
  modified_base (427)..(427): a, c, t, g, unknown or other
  modified_base (529)..(529): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggattcacccttagaagttatggatgacctgggtcccnccaggctccgaggggaaggggctgggagtggggtggaccaaacgataaaacgaaagacggaagtacaagaaaaacctagtgtagactntgtagacggcgattcaccatcnccagacacaacncccaaagacttcactgttattgactaaatgaaacacgctggaagaggacgaggaccgacgggcttagtaattagtgtgcgacgagatagatagtacgactanacaagtacgagtaggtgtactggatttg

SEQ ID NO: 372547 - DNA, 630 bp, Homo sapiens
  misc_feature: GZ8MTXP02FRYH7.15.67.G01.1.454.CMB.2.raw
  modified_base (276)..(276): a, c, t, g, unknown or other
  modified_base (336)..(336): a, c, t, g, unknown or other
  modified_base (594)..(594): a, c, t, g, unknown or other
tcagtctacgtagccacgaccggtgctcgatttagagtatacatattgggtttgaggtctcagagaggagccttagccctggactccaaggcctttctacttggtgatcagcactgagcacagaggactcaccatggagttggggctgagcttgggttttccttgttgttattttagaaggtgtccagtgtgaggtgcacgttggtggagtcgtgggggagtcgttggtccgagggtcccggggggtccctggagacctctccgtgtgctagtctntggtattcaccgttagtagttatggatgaccgtggtccgccgagcgtcgaggggaggcgnggtaggtggtcgacctaaacgaataaaacgaaagaaccggaaagtacaaaagtaaaaaccttgtacggtagtactcgtaggtacggtacccgggcctaacttccgaaccctactcctacccgagaaacgaccaaaccgtaacgaaagtattacctaactagttaagttagaacctaaaatcgaaacacgcgtaagagagacggagaccgcgtcgtagttattagtgacgcgcgtagagagtaagacgtactaccgtanacgtaaggtacgcgtaggtagtagtaggacctttgg

SEQ ID NO: 372548 - DNA, 581 bp, Homo sapiens
  misc_feature: GZ8MTXP02FRCKZ.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctggagactctcctgtgcagtctctggacttcacccttagtaagttatggatgacctgggtccgccaggctcgaggggaagggctggagtgggtgccaacataaacgaaagacggaagtcaagaaaacctgtgtagactctagtagaccgggccaagttccaccatctaccagaagacaacgtccaaagattcacgttgtaacttgacaaaagtcgaaacacgccgtagaagacggaggacggacacgggccgttagtacttagtgtcggcgtacgagtagtggaaacttagagtactctaacgtaagtacggagtacggggtagtatcgtaagttcg

SEQ ID NO: 372549 - DNA, 739 bp, Homo sapiens
  misc_feature: GZ8MTXP02HRFBO.15.67.G01.1.454.CMB.2.raw
  modified_base (517)..(517): a, c, t, g, unknown or other
  modified_base (587)..(587): a, c, t, g, unknown or other
  modified_base (652)..(652): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaggtgtccagtgtgaggtgcacttggtgggaggtcgtgggggaggtcttggtccgagggccggggggtccctggagactcctcctgtgcagtctcgtggtacttcctacccgttaagtaaggtttaattgggtagtacggtacccgttcggggtccccgccgaagggcctccccggtaaaggggggaacggggtcgtaggggtaaggttgggggtcggacccaaaagtaaacgtaaaaaccgaaaaggaaacggggaaggtaaacaaaacgtaaaaaaccgtagttacgttaggaacctttcgtaggttacggaaccggggccgttaaattccaaaccctnttccccgacaaaggcgtaaaccaaccggaacccaaaggtacttacacttgttaatttcgaacaaaagtanaaccgagtccgaggacggaaggcggaaggtacgaccgggcgttgttaattagtcggtgacccggngtaagtagtacgttaagaagtttaacgggaccttaacgtaaccgtaaggtaacgtcgtaagggggttaagtcgtacggtattttggg

SEQ ID NO: 372550 - DNA, 730 bp, Homo sapiens
  misc_feature: GZ8MTXP02GY7W9.15.67.G01.1.454.CMB.2.raw
  modified_base (291)..(291): a, c, t, g, unknown or other
  modified_base (309)..(309): a, c, t, g, unknown or other
  modified_base (328)..(328): a, c, t, g, unknown or other
  modified_base (331)..(331): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggtcgttggtccgaggcccgggggggtccctggacgactctcctgtgcagtctctggattcacctagtaattntggatcgaccgtggtccncgaggctcgaggggaggcnggngtgggtggaccaacaaataaacgaaagtaacggaagtacaaaaggtaaaaaccctagtagtacgtaacttcgtggtacggaccggtccgtaacttcccaacctacgttaccgacccgaaaggaaacgtaacgaaacccggtaacaaacggtaaacttccctaagttcggtttaatttacggaaataaaaccgttagaaaaccgtacgaccgtagggaaggaaccgggacgggttaacggaaccgtaccggggtacccgttagggttaacctttaagtttcggggtcggtacggtaacggtagtacgtaacggtaaagttaaccggttaacgtaaccgttaacgtaaggtaacggtaacggtacgggttacgggttaggtacgttacggttaccgtttag

SEQ ID NO: 372551 - DNA, 637 bp, Homo sapiens
  misc_feature: GZ8MTXP02IYURR.15.67.G01.1.454.CMB.2.raw
  modified_base (436)..(436): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagttcgtggggggaggcttgggtccgagggcccgggggggtccctggagacttctccgtgtgcagtctctggtattcaccttagagttatgatgaccgtggtccgcgagccgtcgaggggagggcgtggaggttggggcgaccaaataaataaaacaaaaggaggaatagaaaagaaaaacctatacgtagacttgtaggtacacggggtcctacttaccacctacttcnccaagacgaactaacgaccaagaattcacttgtacttgacaaatacgactagccgtagaggaaggaccggaggaacccgtcggggtaccgtaggttacgttaagttggtcggaccgtacggagagttggtaagttaggtaaccgacgttacctaaagtaaccggttaagacggtagggtaggttaccgtgttaacgtttgg

SEQ ID NO: 372552 - DNA, 602 bp, Homo sapiens
  misc_feature: GZ8MTXP02F803A.15.67.G01.1.454.CMB.2.raw
  modified_base (310)..(310): a, c, t, g, unknown or other
  modified_base (438)..(438): a, c, t, g, unknown or other
  modified_base (549)..(549): a, c, t, g, unknown or other
  modified_base (598)..(598): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagcttggtccaggccggggggtcctgagactctctgtgcagtctctggtattccaacccttagtaagttattgggatcgaccgttcgggcccncaggctaccgaggggaagggctgggaggtggggtcggaccaaacaagtaaaacgaaaaggaacggaaggtacaagtaaaaaaccctgtcgtaggactcgtgtaacgaccggggcctaattcaaccctntaccaccagaagaacctaacgacaaagacttacgatagtatttagacaaatgaaatacgaccaggagagggacgaacgaacgacgtcgtaggttattagtgacgcgacganaggtctaataaggactaaaccgactaacgtgtacgacgtaggtgtagtntatg

SEQ ID NO: 372553 - DNA, 753 bp, Homo sapiens
  misc_feature: GZ8MTXP02JH57G.15.67.G01.1.454.CMB.2.raw
  modified_base (507)..(507): a, c, t, g, unknown or other
tcagtctacgtagccacgaccggtgctcgatttagagtatacatattgggtttggggtctcagagaggagccttagccctggactccaaggcctttccacttggtgatcagcactgagcacagaggactcaccatggagttggggctgagcttgggttttccttgttgttattttagagtgtccagtgtgaggtgctacgttggtggagtcggtgggggagtccgttggtccgagggcccgggggggtccctggagtactctcctgtcgctagttcctcgtaggtacttcctaacccgttaagtaagtttagtggtaatcgtaccgtcgggtccccgccgaggcctaccggaggggacggggcgtagggaggtggggtcggaccaaaacaaacgtaaaacgaaagacgggaaataccaaaaggaaaacttagtgtaggacctcgtggacggaaccgccgtacttacgacctaacttccacgaggaacaacccgaactacccgaaaanaactttcacgtttagttaattgaaactaaaggtacaaaccgagtccgaaggacggacgggtacgggacgggaaccgaaccggggtccggtttaagtttaacgtttagttaccgggttggacccggtaggaaacggttagttagggtaaacttaaaccgttaacgggtacccttttaaaggaaccgttaaaggaaccggtagtaacggggttacggttaaatcccgggtaaactttaccggttttag

SEQ ID NO: 372554 - DNA, 634 bp, Homo sapiens
  misc_feature: GZ8MTXP02F6ZRH.15.67.G01.1.454.CMB.2.raw
  modified_base (265)..(265): a, c, t, g, unknown or other
  modified_base (450)..(450): a, c, t, g, unknown or other
  modified_base (567)..(567): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggagcttggtccaggccgggggggtccctgagctctcctgtgcagtctntggattcacccttagaagttatggatgaccgtggtccgccgaggcctccgaggggaagggcgtgggaggtggggtggaccaaacaagtaaaacgaaaacggacgggaaagtcaaaagaaaaaccgtatggtaggtactacgtggtacgaccggtccgaaacttcaaccgtatcctaccgaacganaacgtaaccgaccaaagtacttacacgtgttaattgaacaaatggaaactaggcctaggacgaggacggaaggaccgaacgggtccttagtagtttagtaggtacgacgcggaagtnttaggattaaccggtagacctcgttaaacgaaggttacgagtaggggttagtatacgggaatttcgg

SEQ ID NO: 372555 - DNA, 831 bp, Homo sapiens
  misc_feature: GZ8MTXP02JWW55.15.67.G01.1.454.CMB.2.raw
  modified_base (333)..(333): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggttttcctgttgttatttagaggtgtcagtgtgaggtgcacttggtggagtcgtgggggaggtctttggtccgacgggcccgggggggtccctggacggactcctcctgtgacagtctcgtgacttccaccttagattagtaggatgacgtggtccgcacggctaccggaggggacgggngtgggaggtggtacggaacctaaacgaaacgtaaaacgaaaaggaaccggaaaggtaccgaaaaagtaaaaaccccgttgtagggtacggtaaaccgttcggttcggtaaacggacccggggtaccgtaaaactttccccggaaaccctaacgttacccgtaaacccggacggaaaaccggttaaacccgaaaacccggtaaccctaaaaaggttaaacttacccgttaaacgttagggttattttaaacggaacctaaaaggttaccccggaaaaattccggtaccgtaaggaaccgggaggtttaaacgggggaacggttaaaacccgcggggttaacccgttaagggtttacgtttaaagtttaccccgggggacggacggtaacggtaaagtaaggttaacgtaaacggttaaacccgttaaacgacgttaaccgtaaaggtaaaggttaacggtaacgggtttacggttaacgtacgtttacggtttagtcgg

SEQ ID NO: 372556 - DNA, 715 bp, Homo sapiens
  misc_feature: GZ8MTXP02JL5KO.15.67.G01.1.454.CMB.2.raw
  modified_base (304)..(304): a, c, t, g, unknown or other
  modified_base (371)..(371): a, c, t, g, unknown or other
  modified_base (574)..(574): a, c, t, g, unknown or other
  modified_base (709)..(709): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagaactcaccatggagttggggctgagctgggttttccttgttgttatttagaaggtgtccagtgtgaggtgcacgttggtggaggtcggtgggggaggtcgttgggtccgagggtcccgggggggtccctggagaccttcctccgtgtgcagtctcgtggattcctaccgttagaagttnttggatgaccgtgggtcccgcacggctacggaggggaggggcgtgggaggtgggtaggacccaaaanaaagtaaaacgaaaacggacgggaaagtaaccaaagtaaaaaccccgttgtaggtacggacttcggtacgtagggacccggtaccgtactttacccgaaccctacgttcccgtaaccgaggaaacggaaaccaaacccgaaccgtaaaacgtaacttacccgtaacttaggttaactttacggtaaccaaaagttacgaaacnccggtaccgtaggaagggacgggaacgggaacggtaccgaccggtaccggtagttatttaggttgtcgggcgtacggagtagtacgaaagttgaacgactacgtagtaaggtgaacgtaggggtagtagtacgtntttagg

SEQ ID NO: 372557 - DNA, 559 bp, Homo sapiens
  misc_feature: GZ8MTXP02H3G5S.15.67.G01.1.454.CMB.2.raw
  modified_base (535)..(535): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggaggtctgggggaggcttggtccaggccggggggggtccctgagactctcctgtgcagtctctggattcacccttagagttattggatgacctgggtccgccaggctccgaggggaaggggctggagtgggtggccaaagaataaaacgaaagaacggaatacaagtaaaaacctatgtgaactctggttcgaccgggccgtattccacctatcgtacccagacgacacgacccaaagaattccatcgtatttgacaaatgaaacagcctagagaggcgaggacacggcgtagtattatagtgacgtcgagatagatatagacttacagngttagcagggtagtaatgtattcg

SEQ ID NO: 372558 - DNA, 634 bp, Homo sapiens
  misc_feature: GZ8MTXP02FTV0O.15.67.G01.1.454.CMB.2.raw
  modified_base (493)..(493): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcgttggtccgaggccggggggtccctgagactctcctgtgcagtctctggattcacccttagaagttattggatgaccgtggtccgccaggctccgaggggagggctggagtgggtggaccaaacataaaacgaaagacggaagtacaagaaaaacctagtgtaggacttctaggtaggaccgggccgtaagttccaaccctagtccctaccgaagaacgaacaacccggaccaaaaggtaattaccacgttggttaatttcgaactaaaangtaaaacgacgaccgtaggaagacgggacggaaggaacccgagggccgttggtaatttagttgtacgcggtacgagtataggtaattacggtacgtaactcgtaacgtaaggtagacgtaggttaggtagtacgtagtttg

SEQ ID NO: 372559 - DNA, 746 bp, Homo sapiens
  misc_feature: GZ8MTXP02IZNZY.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgctacgttggtggagtcgtggggggaggcttgggtccgagggcccggggggtccctgagactcctcctgtgcagtctctggtacttcctacccttagtaagtttagttggatggtaccgttcgggcccgaccgacggccgtaccgagggggaaggggtcgtggggaaggttcggggtacggaacctaaaacgaaagtaaaaaccgaaacgggaaaccggtaagtaaacgaaaacgtaaaaaaccgtagtaggtaggaaccgtttcgtaggttacggaaccgggtcccgtaaattcccgtaacccacgttacctaccgaaaggaaacgaaacctaacccggaaaccaaaacgtaaactttcccgaaacgtttacgtttaaagttttacggaaacctaaagtaacgtaaaccgacgtaccgtacggaaggacgggacggaaacggtaccgaccgggtccgttagttaaacgtttgttaggtacggccggagtagagttacgaagttacgataaccgtactaagtaagagagtacggtagtagtcgtaagtttg

SEQ ID NO: 372560 - DNA, 612 bp, Homo sapiens
  misc_feature: GZ8MTXP02F1ZKK.15.67.G01.1.454.CMB.2.raw
  modified_base (260)..(260): a, c, t, g, unknown or other
  modified_base (493)..(493): a, c, t, g, unknown or other
  modified_base (499)..(499): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaagtgtccagtgtgaggtgcagttggtggagtcgtgggggagtcttggtccgacgggccggggggtccctgacgactctcctgtncagtctcgtggtatccaccttagaagttattgatgaccgtggtccgcgaggccgtccgaggggacggctggggcgtgggtcggacaaacgaactaaaagaaacgaacggaaatacgaaaaggtaaaaaccccttagtagtaggaccttgtacggtacgacggtccgataccaacctgttcgaccaagaacgaacaaacccgacgaaagtaattcaacttgttaatttcgaaanaaatanaacgaacgacgagaggaggacggacggacgtacggtacgtagttagtagtgtgcgtacgagagtagtagtacgtacgtactactagaagtacgtagtagtagtagtagtagtg

SEQ ID NO: 372561 - DNA, 575 bp, Homo sapiens
  misc_feature: GZ8MTXP02FKX00.15.67.G01.1.454.CMB.2.raw
  modified_base (313)..(313): a, c, t, g, unknown or other
  modified_base (349)..(349): a, c, t, g, unknown or other
  modified_base (351)..(351): a, c, t, g, unknown or other
  modified_base (380)..(380): a, c, t, g, unknown or other
  modified_base (384)..(384): a, c, t, g, unknown or other
  modified_base (390)..(390): a, c, t, g, unknown or other
  modified_base (412)..(412): a, c, t, g, unknown or other
  modified_base (569)..(569): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcttgttgttattttagaaggtgtccagtgtgaggtgcacttggtggagtcgtgggggaggcgttggtccgagggcccgggggggttccctggagaccttctcctgtgctagtctcgtggattcacccttagaagttatggatgacctgggtccncgaggctccgaggggagggctggagtggtgaccaananaaacaaagacgaagtacaagaaaaacctntagngactcngtacgacggcaattccacatcnccagacacaaacgctaaagaactcactgtactttagaactaaaagtagtaaacgagtcccgtagaggagggaccggaagaccgaacggccgtagttattagttgtgacgtcgagatacgataagtacgactctaagaagttagcgtaggtgttacgngtatgg

SEQ ID NO: 372562 - DNA, 667 bp, Homo sapiens
  misc_feature: GZ8MTXP02GWOF3.15.67.G01.1.454.CMB.2.raw
  modified_base (272)..(272): a, c, t, g, unknown or other
  modified_base (317)..(317): a, c, t, g, unknown or other
  modified_base (358)..(358): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacgttggtggaggtcggtgggggaggtcgttggtccgagggcccgggggggtccctggacgactctcctgtgcngtctcgtggattccaccttagaagttatggatgaccgtgggtccncaggctccgaggggacgggcgtggaggtgggtgacccaaanaagtaaaacgaaaggaacggaagtacaaagaaaaacctgtaggagactgtggttagaccggccgtatcccaaccatccgtaccaagaacgaaccaaacccgacaaaagaacttacacgttacgttacgtttacgaactaaaagtacgaaacgacgtaccgtaggaaggaacggcgggaaagaccggacgggtaccgttagtttaacgtttagttggacgtacgggacggaaagtacgtagttaaagtaaggttaacgaccgttacgtaacgtaaggtaagacgtaggggtagttaagtcgtaagtttcg

SEQ ID NO: 372563 - DNA, 588 bp, Homo sapiens
  misc_feature: GZ8MTXP02JOIVI.15.67.G01.1.454.CMB.2.raw
  modified_base (483)..(483): a, c, t, g, unknown or other
  modified_base (526)..(526): a, c, t, g, unknown or other
  modified_base (535)..(535): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggagtcttggtccaggccgggggggtcctgagactctcctgtgctagtctctggtattcacccttagaagttattggatcgaccgtggtccgcaggctccgaggggaacgggctgggaggtggggtggaccaaacaataaaacgaaaggaaccggaaagtacgaaagaaaaaccctgtagtaggactcgtaggtacgaccggccgtattaccacctatacctaccagaacgacaacgcaaagatcgactgtatttgacaatcgaaacngacctgacggaggcgagaccgacggtacgtagtattacgttgngcggtacgngaagtgaagtagttagacctatacgaagtacgacgtaggtgtactgtagttcg

SEQ ID NO: 372564 - DNA, 752 bp, Homo sapiens
  misc_feature: GZ8MTXP02GKOMS.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccagggccggggggtccctgagactctcctgtcgcagtctcgtggtacttaccacccgttaagtaagttagttaggatcggaccgttcggggtcccgaccgaggtcctaccggaagggggaacgggggtcctaggggaggttcggggtacggaccaaaaccgtaaagtaaaaacgaaaaggaaacggaaaggtaacgaaaacggtaaaaactacgtaggtacggaacgtttcgtaggtacggtaccggggtctaacgtttccaacctattaccctaccgaagggaaacaaaccgaaacccgaccctaaaaggtaactttaccgtaacgttgtttaagtttacgaaactaaaacgttacggaaaacgacgtaccgtaggggaaacgacggggaacccgggtaaggaacccggaccgggttaccgttgtttaaagtttagttgggtcgacggaacggagtaagtaggtaaattaggttaacacgtcttaaacgaagttacggacgtaagggtgtagtagtacgtttgg

SEQ ID NO: 372565 - DNA, 597 bp, Homo sapiens
  misc_feature: GZ8MTXP02HE8LD.15.67.G01.1.454.CMB.2.raw
  modified_base (305)..(305): a, c, t, g, unknown or other
  modified_base (343)..(343): a, c, t, g, unknown or other
  modified_base (378)..(378): a, c, t, g, unknown or other
  modified_base (535)..(535): a, c, t, g, unknown or other
  modified_base (586)..(586): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgctacttggtggagtcgtgggggaggcttggtccgagggcccgggggggtccctggacgctctcctgtgcagtctctggattcacccttagagttatggatgactggtccncaggctccgaggggagggctgggagtgggtgaccaaanagtaaaacaaagacggaaatcgaaagaaaaacctntaggagactcgtggagtaccgggccgtattaccgacctatcctaccagacgacaaccgaccaaagtaatcactgtattacgacaaatgaaacacgtacctggaagggacggcggaacggtaccgacgggtccgtaggttaatttagtggtcgaccgnggaagagtagtaacgtagtacgacttccaagaagttagcgtagggtagtancgtaagttcgg

SEQ ID NO: 372566 - DNA, 686 bp, Homo sapiens
  misc_feature: GZ8MTXP02GXYCW.15.67.G01.1.454.CMB.2.raw
  modified_base (393)..(393): a, c, t, g, unknown or other
  modified_base (546)..(546): a, c, t, g, unknown or other
  modified_base (600)..(600): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggaggttggggctgagcttggttttccttgttgtttattttagaaggtgtccagtgtgaggtgctacgttggtggaggttcggtagggggtaggtcgttcgggtccgacggggcccgggggggttccctggacgtactcctcctgtgctagtctcgtggtacttacacccgttaagtagtttatggatcggtaccgtcgggtccgccgagccgtacggaggggagggctgggtaggtgggtacggaccaaaacgtaanaaaacggaaaggtacggaaatacaaaaggaaaaccttgtacgtaggtacttcgtaggtacggacccgggtctacttaccgaccttatccctacgaaagaacgaaccaaccgacgaaattacttaccgattaggtttaacttagaactaagtanaaacgacgacgtgaggagggacgacggaacgtcgggactaggtttaatttaggngtacgagtcgaagtagtagtaaaccgtagtaacgtacctagtaacggtaaggtacggtacggttaggttagacggtttatgtttag

SEQ ID NO: 372567 - DNA, 582 bp, Homo sapiens
  misc_feature: GZ8MTXP02F8G3I.15.67.G01.1.454.CMB.2.raw
  modified_base (345)..(345): a, c, t, g, unknown or other
  modified_base (377)..(377): a, c, t, g, unknown or other
  modified_base (407)..(407): a, c, t, g, unknown or other
  modified_base (418)..(418): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggcccgggggggtccctggagactctcctgtgcagtctctggattcacccttagagttattggatgacctggtccgccaggctccgaggggaagggctggaggtgggtgaccaaanataaaacaaagacggaagtacaagaaaaactntgtaggactctgtagaccggcgattcacgntactccaaganaacaaccgacaaacgattacgactacgttatttgactaaaatgaaacgcgaccgtagaaggagggacggaaggaccgacggaccgtagttagttagttagtcgcgacgagatagtaagtagtagacttcaacgaagtacgacggtacggtagtagagtacgttg

SEQ ID NO: 372568 - DNA, 681 bp, Homo sapiens
  misc_feature: GZ8MTXP02IDUN7.15.67.G01.1.454.CMB.2.raw
  modified_base (657)..(657): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtggaggtgcacgttggtggagtcgtgggggaggcttggtccagggccggggggtccctggacgactctccgtgtgctagtctcgtggtacttcctacccgttagaagtttattggatcggaccgtggggtccccgtccgacgggtcctcccggaagggggaacggggcgtggggaggtggggtcggacccaaaacgaaagtaaaaacgaaaacgaacgggaaatacgaaagtaaaaaacctagttagaggtactacgtggtacgaccggacgtagttaccaccgtactccgtacagaaacgaacaaaccgtaccgaaagtaaacttcctaacttagtttaacgtttacgaaactaaagtaacgtaaacgacgtaccgtagaggacgggacggacggacgaccgggtacgtgttaagttaagttgtagcgacgagtgagtagtacgtacgtacctacaagtaaggttanacgtaggtagtactagtagtttag

SEQ ID NO: 372569 - DNA, 828 bp, Homo sapiens
  misc_feature: GZ8MTXP02H5U10.15.67.G01.1.454.CMB.2.raw
  modified_base (330)..(330): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttcttgttgttattttaggaaggtgtccagtgtggaggtgcacgttgggtggagtcggtgggggaggtcgttagggtccgaggggcccgggggggtcctggacgtactctccgtgtgcagtctcgtggtacttccctaccttagaagtttagtggatcgaccgtgggtcccncacgactaccggaggggggtaacgggctaggggtggtcggggagaaacccctaaagaaaagttaaaacgaaaagggaaaccgggtaaataacgaaaacgtaaaaaaacgttgtagggtaggaacttccgtagggttaaacggaccggggaccgttaattacccccaactacttacccaaccgaaagggaaacaaaccccgaaaacgacccggttaaaacgtaaactttcccgtaaaagtttggttaaaaccttttaggaaaacccttaaacgttaaggaaaaaacttccccgacggttaacgggaaaaggaccgggaacccggggaaaagtttaaaccggggcccccggggaacgttttacgtaaggtttttaaagtcccgggtaaaagggtcccggaacggtaagtttaggggaactaaagttaccccggggttaaaactaacgtaacgtaacgtaacggtacggtacggtacggtaggtacggtacgttacgtacg

SEQ ID NO: 372570 - DNA, 669 bp, Homo sapiens
  misc_feature: GZ8MTXP02FKXWW.15.67.G01.1.454.CMB.2.raw
  modified_base (516)..(516): a, c, t, g, unknown or other
tcagtctacgtagccacgaccggtgctcgatttagagtatacatattgggtttgggggtctcagagaggagccttagccctggactccaaggcctttccacttggtgatcagcactgagcacagaggactcaccatggagttggggctgagcttgggttttccttgttgttattttagaggtgtccagtgtgaggtgctacgttgggtggagtcggtggggggaggtcgttcgggtcccgaggggtccccgggggggggttccctggacggtaccttccgttccgtggtcgcaggttctcgtggtacttacctacccttaaggtaagttattaggatgaccgtgggtccaccgtaggctccgaggggaggggctgggaggtgggtggaccaaacaataaaacgaaaggaacggtaaagtacgaaaagaaaaacttgtaggtggacttcgtaggtacggaacggccgtattccaccactctacaggacgaacaaccgacctaagaacttacacgttnttatttagaactaaagttacgaacgagtaccgtagaagggaggacggaaccgggacgaccgggtacgttagttaagtttgttagcggacgtacggagtagacgtaagtagtacgtacacctagtagaacgagtaggtaggtatgactgtttag

SEQ ID NO: 372571 - DNA, 564 bp, Homo sapiens
  misc_feature: GZ8MTXP02IHXHR.15.67.G01.1.454.CMB.2.raw
  modified_base (370)..(370): a, c, t, g, unknown or other
  modified_base (435)..(435): a, c, t, g, unknown or other
  modified_base (447)..(447): a, c, t, g, unknown or other
  modified_base (449)..(449): a, c, t, g, unknown or other
  modified_base (451)..(451): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggtttttcctgttgttattttagaaggtgtccagtgtgaggtgcacttgggtggagtcgtgggggagctttggtccaggccgggggggtccctgagactctcctgtgcagtctctggattcaccttagaattatgatgacctggtccgcaggctccgaggggaggggtctggagtggtacggcaacataaacaaaggcggaaatcaagaaaaacctntagtacgactcgtagagacggccgattcacccgatcaccagagacaacgacaataacttcagttntattcgataaanananagacagagagagagacgacgacgtagtattagtagtagacgacgagagtagtaagtaacgtacgtactacgtaacgtaacgtaacgtacgtacggtaggtacgttagtagtcg

SEQ ID NO: 372572 - DNA, 710 bp, Homo sapiens
  misc_feature: GZ8MTXP02JQU6F.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgctacttggtggaggtcgtgggggaggtcgttggtccgagggtcccgggggggtccctggagtactctcctgtgctagtctcgtggtacttccacccttagtaagttagttggacgtgaccgtcgggtcccgccgacggcgtcccgaggggacggggtccgtgggtaggtcgggtacggaccgaaaacgtaacgtaaaaacgaaaggtaaacgggaagtaacgaaaacgtaaaaacctagtggtacggtacttcggtgacggaccggtacccgtactttaccaccgtacttaccgtaccacggaaacgaaccgaaaccggacccaaaagtacttcccgtaatttcgttactttacgaaactaaaagttcgaaaacgtgaccgtaggacgaggacgggaagacgacggtccgttagtattgtgtgcgtagacgataggtacgtaagttccgtaaacttctaaacgtaaggttaaccggacggttacggggtagtttacgtcggggtactttttagg

SEQ ID NO: 372573 - DNA, 726 bp, Homo sapiens
  misc_feature: GZ8MTXP02GC5OU.15.67.G01.1.454.CMB.2.raw
  modified_base (646)..(646): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctgggttttccttgttgttattttagaaggtgtcagtgtgaggtgcacgttggtggagtcgtgggggagtcttggccgaggccggggggtccctggagactctccgtgtgctagttctcgtggtacttcctaacccttaagtaaagtttattggactacgtaccgtgggtccccgccgaaggccgtacccggagggggaagggtcgtaggggtaggtggggtaccggaccaaaacgtaaagtaaaaaccgaaaagggaacgggaaattaaaccgaaaaggtaaaaaaccccgttagtacgggttacggaactttccgtaggttaacgggaaccggggtcctaaacttccaacccttactacctacccgaaaggaacgaaccaaaccgacccaaagtaactttacgtacttaggttaatttcggaaactaaaacgtagaaaccgacgaccgtaggaagacgggacggaacgaaccggcggttacggtagttaactttntggtcgaggacgtaagagtgtaaacgttaggtacaacttcgtaagtaacggttaagccggttaggtgtagtcgttagttg

SEQ ID NO: 372574 - DNA, 557 bp, Homo sapiens
  misc_feature: GZ8MTXP02FFWBT.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggattcgtgggggaggcttgggtccagggccgggggggtccctggagactctcctgtgcagtctctggattcacccttagaagttattggatgacctgggtccgcaggctccaggggaaggggctgggagtggggtggccaacaataaaacaaagacggaagtcaaagaaaaacctatgaggactcgtgtgacggccgattcaccatctaccagagacaacgccaaagaattcactgtatttgacaaaatgaaacagcctagagaggacgaggacgacggcgtagtactatgtgcgcgagatagagttagacgtactcgtacaagtacgacgtagggtaggtatggattacgg

SEQ ID NO: 372575 - DNA, 650 bp, Homo sapiens
  misc_feature: GZ8MTXP02H5L5K.15.67.G01.1.454.CMB.2.raw
  modified_base (252)..(252): a, c, t, g, unknown or other
  modified_base (259)..(259): a, c, t, g, unknown or other
  modified_base (333)..(333): a, c, t, g, unknown or other
  modified_base (367)..(367): a, c, t, g, unknown or other
  modified_base (377)..(377): a, c, t, g, unknown or other
  modified_base (466)..(466): a, c, t, g, unknown or other
tcagtctacgtagccacgaccggtgctcgatttagagtatacatattgggtttggaggtctcagagaggagccttagccctggactccaaggcctttccacttggtgatcagcactgagcacagaggactcaccatggagttggggctgagctgggttttcctgttgtattttagaaggtgtccagtgtgaggtgcactggtgagtctgggggagctggtccagccggggggtcctgagactctcctgtagnagtctcnggatctaccctagaagttatggatgaccgtggtcccgcaggctcgaggggtagggctgggagtgggcgccaaanataaaacgaaagacggtaagtcaaagaaaacctngtggaacttntacggtagacgccgtattcaacatcgtaccagaacgacaacgtacccaagtaaatctactagtagtttacgactaaatagtaaaccganacccgtaaggcgaaacgggacgaacggggaacgttaaaccggtccggttacgggttaaactttaacggttagttcggacgttacgggaaaacgtgttaccggaaatacggtttaaacggaccttacgaaaaccgtggttaaaaggccgtaaaacggtcggtttaacgtacgggtaaccctttgg

SEQ ID NO: 372576 - DNA, 918 bp, Homo sapiens
  misc_feature: GZ8MTXP02IO1HR.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtgaggtgctacgttgggtggagtcggtgggggaggtcgttgggtcccgagggccccgggggggttccctggagtacctcctccgtggtgcagttctcgtggtacttcaccgttaagaacgttattggatcgaccgtcggccgtccgacggccgtccggaggggaacggggtcgtaggggtaggtggggtacggaccctaaaacgtaaacgtaaaaacggaaaacggtaaaccgggtaaaggtaaaccgtaaaagtaaaaaacccgtttaggtacgggttaacgggtaaaccgttcggtttaaggggtaaccgggtaacccgggggtacccgttaaacgtttacccccgaaacccgttaccgttaccccgttaaacccgggaaacggaaacccgaaaccgaaaacccggaacccgtaaaaacggtaaaccttttaacccgaaacgtttacggttttaaacgttttaaccgaaaaccgttaaaagttacggaaaaccgtacggtaaccccgtaggggtaaacggggaccgggtaacggggaaaaccgggtaacccggtaacccggggttacccgggtttaacgtttaaacggtttagtttaacccgggtaggtacccggtaaacgggtaacggttaaagttaacggttaaacggttaaggtaaccgttaaaccgttacgtaaacggtaagtaaacggtacggttacgggtagttacgttacggtagttttcg

SEQ ID NO: 372577 - DNA, 662 bp, Homo sapiens
  misc_feature: GZ8MTXP02HN3EL.15.67.G01.1.454.CMB.2.raw
  modified_base (304)..(304): a, c, t, g, unknown or other
  modified_base (344)..(344): a, c, t, g, unknown or other
  modified_base (380)..(380): a, c, t, g, unknown or other
  modified_base (561)..(561): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtctggggggagcttggtccaggccgggggggtccctgagactctcctgtgcagtctctggattcacccttagaagttatcggatgaccgtggtccnccaggctcgaggggagggctggagtgggtggccaaataanaaaacgaaagaacggaatacgaaagtaaaaaccctntggtaggacttcgtaggttgaaccggggtccgtaattaccaccaattccgtacccaagacgaacaaacccggtccaaaacgtaatttaccacgtgttaatttcgactaaaagttcggaaaactagcccgttaggaccggaagggcgggaacggacgacggggtacccgtaggttaactttnttgggtcgaaaccgggtcggtaagtagtagtaaagttaacggtaacgtacccttaacgtaacgtaacggtagacgggtaggtagttaacgtggtaagttcg

SEQ ID NO: 372578 - DNA, 608 bp, Homo sapiens
  misc_feature: GZ8MTXP02H1P04.15.67.G01.1.454.CMB.2.raw
  modified_base (261)..(261): a, c, t, g, unknown or other
  modified_base (271)..(271): a, c, t, g, unknown or other
  modified_base (282)..(282): a, c, t, g, unknown or other
  modified_base (375)..(375): a, c, t, g, unknown or other
  modified_base (465)..(465): a, c, t, g, unknown or other
tcagtctacgtagccacgaccggtgctcgatttagagtatacatattgggtttgaggtctcagagaggagccttagccctggactccaaggccttttccacttggtgatcagcactgagcacagaggactcaccatggagttggggctgagctgggttttcctgttgttattttagaaggtgtccagtgtgaggtgcattggtggagtcgtgggggaggcttggtccgaggccggggggtccccgtgagactctcctgtgnagtctctggnttcacccgtanagttatgatgacctcggggcgccaggctccgagggaaggggctggagtggtggccaaacgataaaacaaagacggaagacaagaaaacctaangtaggactctgtagacgggtcgacgttcaccagtctaccagacgaccaaacgtaccaaagtaaacttcaactgtatttagacgtaaaacntaaaccgagacctagggagtacgggcggaaagtcgaaccggcgtttgtaactttgtcgtcggcgacggatagttgaaaaccgttaaatcggaacctttacgaagtcgttaacggaggtaggttgggtaatttgaaccggtttg

SEQ ID NO: 372579 - DNA, 657 bp, Homo sapiens
  misc_feature: GZ8MTXP02G98BP.15.67.G01.1.454.CMB.2.raw
  modified_base (320)..(320): a, c, t, g, unknown or other
  modified_base (627)..(627): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttgggtggaggtcgtggggggaggtcgttggtccgacggcccgggggggtccctgagacctcctccgtggtgcagtctcgtggtattccaaccttagaagttatggatgaccgtggtccnccgaggctcgaggggagggcgtggaggtgggtcggaccaacaagtaaaacaaaggacggtaaagacaaagaaaacctgtagtacggactcgtaggttacggaccggtccgtacttaccgaacctatacctaccgaaggaacgtaaccgaaaccggacccaaaagtaacttacgtaaccgttagttatttacgaaactaataacgaaatacgactagggacgaggacgggagaaccgtacgggacgttagttagttacgttagtcgacggtagacgtagacggtagtaacggtacaacgttcaaacgngtagaccgtagggtagtaagtcgatttagg

SEQ ID NO: 372580 - DNA, 777 bp, Homo sapiens
  misc_feature: GZ8MTXP02GSVDE.15.67.G01.1.454.CMB.2.raw
  modified_base (313)..(313): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggagtcttggtccgagggccggggggtccctgagactctcctgtgcagtctcgtggtattcctacccttagaagttattggatcgaccgtgggtccnccgaggctccgaggggaacggggctgggaggtggggtcggccaaaacaataaaaacaaaggaacggaaagtacaaagaaaaaaccttagtgtaggaacttcgtaggttgaccggtccgattaccgacctatctacccgaatacggaaacccaaacgacccaaaagtaactttacccgaacgttacgttaattttacggaaccttaaaaagttcgaaaacgtaccggtaccttagggaaacggacggggaccgggtaaaacggggaaacccggtaacccgggggtacccgggtttaacggttaaaacgtttttacggttaagggtttacggacccgggtaccgggtaaaagggtacgttaaacggaaaggtttaaaaggtaaccgtaacccgttaccgtaaaaccggtaagtttaaacggaccggtaaacgggggttaggtttaacggtacggttagtttaccgg

SEQ ID NO: 372581 - DNA, 614 bp, Homo sapiens
  misc_feature: GZ8MTXP02HELEZ.15.67.G01.1.454.CMB.2.raw
  modified_base (304)..(304): a, c, t, g, unknown or other
  modified_base (349)..(349): a, c, t, g, unknown or other
  modified_base (389)..(389): a, c, t, g, unknown or other
  modified_base (417)..(417): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccaggccgggggggtccctgagactctcctgtgcagtctctggatcacccttagaagttatggatgaccgtgggtccnccaggatccgaggggaaggggctgggagtggggtgaccaaacaanaaaacgaaagacggaatacaaagaaaaactatgaggactntgagacggccgattaccacatcacaganacaaacgaccaaagtaattacaatgttaatttagactaaaatgaaaacaggtacctaggacgaagggcggaaacgggaccacgggaccgttaggtaatttaagttggacggaccggtacgaaaggagttaggaacttaaaggtaagtaactacttaaacgaagttacgacggtaaggttggggtaaatcggaatttg

SEQ ID NO: 372582 - DNA, 744 bp, Homo sapiens
  misc_feature: GZ8MTXP02FU8VE.15.67.G01.1.454.CMB.2.raw
  modified_base (327)..(327): a, c, t, g, unknown or other
  modified_base (697)..(697): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagcttgggttttccttgttgtttattttagaaggtgtccagtgtggaggtgctacgttgggtggaggtcggtgggggaggtcgttggtccgacggggccggggggtccctggagacctctcctgtgcgagtctcgtggtattctacccttaagtaagttagttggatgaccgtgggtccnccgaggctccgaggggaacgggcgtgggagtggggtcgaccaaaacgaaataaaaccgaaaaggacgggaaagtacgaaaagaaaaaaaccccgtagttaggtacggtaaccttcgttaggttaacggaccggggtcccgaactttaaccgaccctacttaccgacccgaaagaaaccgaacgaaacccggaacccaaaaaggtaaacttacgtaaaccgttacgttaagttttacgaacaaaaacgtagtaaaccgaaagtcccggtaaggacggaaggacgggaaaggaacccgtaccggtacccgttaggtttacttaaggttgtacggacgtaccggaagtataggaagttacgtacggaaccctntaaccgtaagtaacggtcgtaacgggttagtagtacggtaagtttcg

SEQ ID NO: 372583 - DNA, 652 bp, Homo sapiens
  misc_feature: GZ8MTXP02F10FL.15.67.G01.1.454.CMB.2.raw
  modified_base (358)..(358): a, c, t, g, unknown or other
  modified_base (368)..(368): a, c, t, g, unknown or other
  modified_base (386)..(386): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtggttttccgtgttagttatttagaaggtgtccagtgtgagtgcagttggtggagtcgtgggggagtcttcggtaccgacgggccggggggtccctggacgactcctccgtgttgacctgtccttcgtaggtacttcaacccttagtaagttaagttggagtagtaccgttcggcccgccgtaggctcccgaagggggtaccgggngtgggtaggnggggtcggacaacgtaanaaaacgaaagacggaaatgaaaactaaaatagtgtacgaaccttggtagtacgaccgggactacgttaccaactactacgtcccgaagtaacgaaacgaacctaaccaaagtactcctaatgttaacttgaacctaaaacgacgaacgacgacgaggacgagacggacgtaaccgacggtacgttaagttagtacgtgtacgacgacgagtagtagtagtacgtacgtactacgtacgtaagtacgtacgtagtgtagtagtagtg

SEQ ID NO: 372584 - DNA, 604 bp, Homo sapiens
  misc_feature: GZ8MTXP02GLMOE.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtggggggaggcttggtccgaggcccgggggggtccctgagactctcctgtgcagtctctggattcacccttagaagttatggatgacctgggtccgccaggctccgagggagggctggagtgggtgccaaacgataaacgaaagacgaaagtcaaagaaaaacctagtgtaggacctctgtaggacggccgattccgaccatctaccagacgacaaacgaccaaagattcactgtaatttgactaaaatgaaactagacccgttggaagacgggacgggaaggaccgaacgggccggttgtaatttagttggttgacgacgtaggattacggattaacgtacggtacttacgtaacaaggttagaccgtaggttaggtaactggtaactttgg

SEQ ID NO: 372585 - DNA, 769 bp, Homo sapiens
  misc_feature: GZ8MTXP02J006F.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatgggagttggggctgagtcgttgggttttccttgtttgtttattttagaaggtgtccagtgtgaggtgctacgttgggtggaggtcggtgggggaggtcgttcgggtccggacggggtcccggggggtccctggacgtaccttcctccgtgtcgcgtacgttcgtcgtggtacttccctaacccgtttaagtaacggtttagttcgggtagttcggacccggttcgggtccccgaccgtacggtcccgtaccgggaaaggggggaacggggtccgtggggagggttcggggtacgaacccgaaaactaaagtaaaacgaaaacgggtaacggaaagtaaaccaaaagtaaaaacccgtgtaggtacgactggtaggtacggaccgggtccgtaaattacccactaccgttacaccgaacgaacgaacaaccgaccaaaagtactactacgtgttaacttagaacctaaagtcgaaacgacgtccggaggaacggaggaccgggaaggtaccgaccgggttacgtagtttaacgtttggtacgcggttaccggaggaacgtagtagtaacgtaaaggtacgttaactacgtaacgtaacggtaagcggttagggtagttagtacgtttcgtttagg

SEQ ID NO: 372586 - DNA, 776 bp, Homo sapiens
  misc_feature: GZ8MTXP02ICR45.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcaccatggagttgggctgagctggttttccttgttgtttatttagaaggtgtccagtgtgaggtgctacgttgggtggaggtcggtgggggaggtcgtttggtccgagggcccggggggggttccctggagtacctcctccgtggtgctagtcctcgtggtacttccacccgtttaagtaagtttaattcggatcgaccgttcgggtccgccgaggctccggaaggggaaggggtcgtagggaggtggggtcggaaccaaacgtaaataaaaccgaaaacggaacggtaagaaaccgaaaagtaaaaacccgtagtaggtacggtaaacgttcgttaggacgtaccggggcccttaacgttaccccacctaaccgttcctaccgaacggaacgaaccaaacccgtacccgaaaagtaactacctaccgttagtttaacgtttagaacctaaatacggtaaactacccgtaccgtacggaagggacgggtacgggaaccggggaacccggtacggggtcccggttaggtttacgtttaaggtttccggtcggtccgggactaaggtagtaaggtaacgttaagggtaccaaacgtttccctaaagtaaggtcgtaacggtgggttaggtttacgtacggttagtttcg

SEQ ID NO: 372587 - DNA, 673 bp, Homo sapiens
  misc_feature: GZ8MTXP02HA97S.15.67.G01.1.454.CMB.2.raw
  modified_base (204)..(204): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggnggagtcgtgggggaggtcgttggtccgacgggcccgggggggtccctggacgacttcctccgtgtcgcagtctcgtggtacttccacccttagaagtttatggatcggaccgtcgggtcccgccgtacggtcctaccggaggggaagggcgttgggaggttggggtcgaccaaacgaataaaaccgaaggaaccggaagtacaaagtaaaacctgtgtcgactcgtaggtcgaccggccgtattacccgactacgtctaccgagaacgacaacgacctaagtaactcgacttagtatttagaacaaagtcgaaacgacgtaccgagggaagacgggacgggttaacggacccgtacgggtaccgttagttaaagtttgttaggtcggacgacggtagtagtaccggaatacggttagtaacccttagttacgaaagtcggtacggtggttaaggttgttaggtagtttg

SEQ ID NO: 372588 - DNA, 708 bp, Homo sapiens
  misc_feature: GZ8MTXP02I0VP1.15.67.G01.1.454.CMB.2.raw
  modified_base (321)..(321): a, c, t, g, unknown or other
  modified_base (371)..(371): a, c, t, g, unknown or other
  modified_base (482)..(482): a, c, t, g, unknown or other
  modified_base (501)..(501): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtccagtgtggaggtgctacgttgggtggagtcggttgggggaggtcttgggtccgagggtcccgggggggtcctggacgacttctcctgtgctagtctctgtactctacctagaagttattggatgacccggtggtaccncgaggcctaccggtaggggaaggggctgggacgtggggtgaaccgaaaanaagtaaaacgaaaaggaccggtaaagtacgaaaacgtaaaaaccctggtacgtaacggggctttgtcggtacgggacggccgtaacgtcctaccagtccctagaacggaanacgtaccacgtaatacttnaacgttgttactagtacaatcaaccgtagccaggtaggaaccgtgggaacggaccgacgggttacccgtagggtttaccttaggttacggtcgccgggtacggattaggtacccggtaattaagttaccggtaccctaacgggtaaaactgggttaaaaccccgggtacggttaacggggtttaggtcgttacgggttacgtttcgg

SEQ ID NO: 372589 - DNA, 586 bp, Homo sapiens
  misc_feature: GZ8MTXP02JH9J0.15.67.G01.1.454.CMB.2.raw
  modified_base (306)..(306): a, c, t, g, unknown or other
  modified_base (311)..(311): a, c, t, g, unknown or other
  modified_base (376)..(376): a, c, t, g, unknown or other
  modified_base (405)..(405): a, c, t, g, unknown or other
  modified_base (408)..(408): a, c, t, g, unknown or other
  modified_base (425)..(425): a, c, t, g, unknown or other
  modified_base (447)..(447): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttgggtccaggcccggggggggtccctgagactctcctgtgcagtctctggattcacccttagaagttatggatgacctggtccncagcnccaggggagggcgtggagtgggtgaccaactaataaacaaaggacggaagtacaagaaaaacctntggagacattgagacgccgtatcacatcncanagacaacgaccagactnactgtattgactaaagataaancaccgtgaaggacgggacgagtaccgacgggtccgtaggttattacggttgtacggcgacggagtagaggtataaaggtacgtacttaccaacgtaaggtacggtaacgtaaggggttagacggtttagtacgtttagg

SEQ ID NO: 372590 - DNA, 637 bp, Homo sapiens
  misc_feature: GZ8MTXP02JA7JD.15.67.G01.1.454.CMB.2.raw
  modified_base (317)..(317): a, c, t, g, unknown or other
  modified_base (342)..(342): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttatttagaaggtgtcagtgtggaggtgcacgttggtggagtcggtgggggaggtcgttggtccgagggcccggggggggtccctaggagaccgttctcctggtgcagtctcgtggatctaccttaagagttatggatcgacgtggtccncgaggctcggaggggaaggctgggngtgggtcgacaaacgaataaaacgaaaggacggaagtacgaaataaaaaccgtgtaggtggacttgtaggtacgacgggaccgtattaccgaccgtatcctaacgaaggaacaacgaaaccgacgaaaacgtaactttcaacgttcgtaatttacggaaccaaaagtcgtaaacacgccgtaagacggaggacggacggacgacggtcgttagtattagtaggtgacgtacggatagtagaaatacggtacacctaaggataacggtcgacgtagggtagtaagtcggtattcgg

SEQ ID NO: 372591 - DNA, 556 bp, Homo sapiens
  misc_feature: GZ8MTXP02F96UT.15.67.G01.1.454.CMB.2.raw
  modified_base (333)..(333): a, c, t, g, unknown or other
  modified_base (346)..(346): a, c, t, g, unknown or other
  modified_base (369)..(369): a, c, t, g, unknown or other
  modified_base (377)..(377): a, c, t, g, unknown or other
  modified_base (385)..(385): a, c, t, g, unknown or other
  modified_base (406)..(406): a, c, t, g, unknown or other
  modified_base (437)..(437): a, c, t, g, unknown or other
  modified_base (492)..(492): a, c, t, g, unknown or other
  modified_base (497)..(497): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacttggtggagtcgtgggggaggcttggtccgaggcccgggggggtccctggagactctcctgtgcagtctctggattcacccttagagttattggatgacctgggtccgccgaggctccgaggggaggggctggngtgggtgaccaanataaacgaaagacggaatacaanaaaacctntgtgactngtagacgccgattcaccatcnccagacacaacgacaagacttcactgtattnacaaatgaaacagcctagagaggacggagaccgacggcgtgtacttatgtcgcgngagangtaagtagttacgactacgtaacaaggtacgacggtaggtaggttacgtagtagttagg

SEQ ID NO: 372592 - DNA, 686 bp, Homo sapiens
  misc_feature: GZ8MTXP02IM7ET.15.67.G01.1.454.CMB.2.raw
  modified_base (311)..(311): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggtttttccttgttgttattttagaaggtgtccagtgtgaggtgcacttgggtggagtcgtgggggagcgttgggtccaggcccggggggtccctgagtacctctcctgtgcagtctcgtgtcttccaccttagaagttatggatgaccgtgggtccncaggcctcgaggggaagggcgtgggaggtgggtggacccaaagaagtaaaacgaaagaacggaagtacgaaagaaaaaccccgttatggtacggaacttcgttagtacgacggggtacctacgttccaacccagttctaccgaaaggaccgaaacaacccggtaacaaagtaactttaccgactttaggtaattttgaaactaaagtacgaaaaccaggtacccgaggaaccgagggaccggaaacggaccgacggggacctttagttaagttactttgggcgacccggtagaggtaaagtccggttaaagaacgggtttacgacctttaacgacgtaaagtaggacgtaggggttagtacttacggatttacgg

SEQ ID NO: 372593 - DNA, 664 bp, Homo sapiens
  misc_feature: GZ8MTXP02FHGL2.15.67.G01.1.454.CMB.2.raw
  modified_base (342)..(342): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggaggcttggtccgacggccgggggggtcctgagacgtctcctgtgctagtctctggacttcacccgttagtaagttagttggatcggaccgtgggtcccgcctaggcctacgaggggaacggggngtggaggtggggtcggaccaaacgaataaaacgaaaaggacggtaagtcaaagaaaaacctagtgtgactcgtgtagaccggccgaatttacgaccctatacctaccaagaacgaaccgaaacgacccaaaagtacttaccgactagttagtttaacgactaaaacgttgaaaaccgaggacccgtaggaggtacgggaacgggacggaaccgaccgggtaccgttagttagttaacgtgttacgcgacgtacgagtttacgaaagttagtaacgacttacaacgtaagtaagacgtaagggttgaaacgttcgagtttcgg

SEQ ID NO: 372594 - DNA, 675 bp, Homo sapiens
  misc_feature: GZ8MTXP02J0CAB.15.67.G01.1.454.CMB.2.raw
  modified_base (249)..(249): a, c, t, g, unknown or other
  modified_base (265)..(265): a, c, t, g, unknown or other
  modified_base (313)..(313): a, c, t, g, unknown or other
  modified_base (317)..(317): a, c, t, g, unknown or other
  modified_base (498)..(498): a, c, t, g, unknown or other
  modified_base (516)..(516): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcttgggttttccttgttgttattttagaaggtgtccagtgtgaggtgcacttggtggagtcggtgggggaggctttggccgagggcccgggggggtccngacgctctcctgtgcngtctcgtaggattccaccttaagaattgtgatcgaccgtcgggtcccnccgnggccgtaccggaggggaacggggctggggtacggtcggggtacgacccaaagtaaacgtaaaaacgaaaacggtaacggaaacgtaaccgtaaaagtaaaaccgtagtggtaggaccttgtaggcgacgggtcctactacaccagtccacgagaacaacaccgtacaaataattcacgttntaagttagaacttaaaanaacgaacgacgtacgtaggacggacgggacgggacggacggtaccggtacggtagttagttagttagtcgtacgtacggtagtagtacgtaacgttaacgtaacgtacgtaacgtacgtaacgtaggtacggtacggttaggtacgtacgttagtttag

SEQ ID NO: 372595 - DNA, 566 bp, Homo sapiens
  misc_feature: GZ8MTXP02I9SHN.15.67.G01.1.454.CMB.2.raw
  modified_base (269)..(269): a, c, t, g, unknown or other
  modified_base (332)..(332): a, c, t, g, unknown or other
  modified_base (375)..(375): a, c, t, g, unknown or other
  modified_base (425)..(425): a, c, t, g, unknown or other
  modified_base (451)..(451): a, c, t, g, unknown or other
  modified_base (490)..(490): a, c, t, g, unknown or other
  modified_base (512)..(512): a, c, t, g, unknown or other
  modified_base (521)..(521): a, c, t, g, unknown or other
  modified_base (533)..(533): a, c, t, g, unknown or other
  modified_base (554)..(554): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgctacttgggtggagtcgtgggggagcgttcggtccgagggtcccgggggggtcctggagacctcttcctgtgnagtctacgtggacttcaccctagagttatggatgacgtcggtcgccaggctcgagggacgggntcggagtgggtcggccaacgaataaaccgaaagaacggtaaanacgtaagaaaaacctgtagtcgacttcgagtcggacgggccattccaccnttaccgccaaggataaccaacgtacngaacttcactgtattgacatagatcgctgagcgcggtanccgaggtccgtagtatgttagngccgagagntgacgtagtacncgtactagaacgtgagagttnaggtttcagtcg

SEQ ID NO: 372596 - DNA, 660 bp, Homo sapiens
  misc_feature: GZ8MTXP02HEB65.15.67.G01.1.454.CMB.2.raw
  modified_base (258)..(258): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttccttgttgttattttagaaggtgtccagtgtgaggtgcacgttggtggagtcgtgggggagcttggtccaggcccggggggtccctgagactctcctgngcagtctcgtggattcacccttagaagttactggatgaccgtggtccgacaggctcccgaggggaacgggtctagggagtggggtcggaccaacaagtaaaacaaagactagaaacgtacaaacgtaaaaaacctgttaggaggactcgtaggtacggtaaaccggggcctaagttacccaacctatccctacccgtaagaacgaaacccaaccggaaccctaaagaaacgtttacaacgttacggttaatttacgggacctaaaattaccggaaactaacgggtcctagacggagggacgtacggacaaccgggtcgtgtacttagttcgcgaccgagagacttgaacgtagttacggcctacgttaacgaggtacgacgaggttacgtagtaaccgtagg

SEQ ID NO: 372597 - DNA, 705 bp, Homo sapiens
  misc_feature: GZ8MTXP02HQZSM.15.67.G01.1.454.CMB.2.raw
  modified_base (219)..(219): a, c, t, g, unknown or other
  modified_base (293)..(293): a, c, t, g, unknown or other
  modified_base (312)..(312): a, c, t, g, unknown or other
  modified_base (319)..(319): a, c, t, g, unknown or other
  modified_base (331)..(331): a, c, t, g, unknown or other
  modified_base (341)..(341): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctggttttcttgttgttattttagaggtgtccagtgtgaggtgcacgttggtggagtcgtgggggaggngttggtccacgggccgggggggtccctggagactctcctgtgctagtctacgtggattccaccgtagaacgttntggatcgaccgtgggtccncgagtcncgaggggaggcngggagtgggngaccaacataaaacgaagaaggagtacaaagaaaactgtagtcgtacttgtcgtaggaccggtcgtaaacttaccaacctacgtacctaccgaagaacgacgtaaaccgtaacccgaaaggtaacttacccgaattaaggtttaactttagacctaaaagttacgaaaacgtacggtaccgagaagggaggaagggaaaccgggacggtaaaccgggacccggttaaggtacgttttaaaggttggtacgggaccgtacgggaagttacgtcgtaaaacggttaacggtaaaggcttaaccgtaaacggtaacggtaacggtacggtaaacgggttaaggtccggttaagtaggtttttaccgg

SEQ ID NO: 372598 - DNA, 877 bp, Homo sapiens
  misc_feature: GZ8MTXP02FQDZK.15.67.G01.1.454.CMB.2.raw
tcagtctacgtagccacgaccggtgctcgatttagagtatacatattgggtttgaggtctcagagaggagccttagccctggactccaaggcctttccacttggtgatcagcactgagcacagaggactcacatggaggttgggctgagtcgttgggttttcctttgttgtttatttagaaggtgtccagtgtggaggtgctacgttgggtggaggtcggtgggggaggtcgttcggtccggacgggggtcccgggggggtccctaggacgtaccgttcgttccgtgtcgctacgttctcgtagtacttcctaaccgttaagtaagttattggactcggtaccgtcgggtcccggaccgacggtaccggtcccgggaagggggaacggggtacggtggggtaggggttcggggtacggaacccaaaacgtaaacgtaaaaacggaaaacgggaaagggtaaacgttaacaaaaacggtaaaaaccttagtacgggtacgtacgttcggtacggtaagggtaccccgggactaactttacccgaaccgtacctaccgttccgaaacggacgaaaccgaaacccggtaacccaaaaggttaaaccttcccgtaacggttaaggttttacttaaacggactaaaaacgttaccggaaaccgtaacgtaaccggtaggggaaaaggacgggggtaaacggaaccgggtaacccggtaccgggttaccgtaaagggtttttaacgtaggttgggtacccggaccgggggtaaataggtaaaccgttagggtaaaccgttaggtaccgttaaaactcccggtaaaaggtccggtaaacggtcggtttaaaagggtcggtttaaaggtccggtttaacgtttgg

SEQ ID NO: 372599 - DNA, 577 bp, Homo sapiens
  misc_feature: GZ8MTXP02FOBHF.15.67.G01.1.454.CMB.2.raw
  modified_base (305)..(305): a, c, t, g, unknown or other
  modified_base (330)..(330): a, c, t, g, unknown or other
  modified_base (385)..(385): a, c, t, g, unknown or other
  modified_base (415)..(415): a, c, t, g, unknown or other
  modified_base (420)..(420): a, c, t, g, unknown or other
  modified_base (435)..(435): a, c, t, g, unknown or other
  modified_base (439)..(439): a, c, t, g, unknown or other
  modified_base (524)..(524): a, c, t, g, unknown or other
  modified_base (569)..(569): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggattcaccatggagttggggctgagctgggttttccttgttgttattttagaaggtgtccagtgtgaggtgcacttggtggagtcgtgggggaggcttggtccagggccgggggggtccctgagactctcctgtgcagtctctggattccaccttagaagttatggatgacctgggtccnccaggctaccgaggggaaggggtcngggagtgggtgaccgaaacataaaacgaaagaacggaagtacaaagaaaaacctntgagactctggtagacggcgatcgacatcnccganagacaacgacgaaanattnaactgttattagaactaaaatgaaacgagtaccgaggacggaggacggtaagaccgaggccgtagttaattagtgtgacgagganagtcgaagtagtacgaactcaagaacgtagacgtaggtagtacgngagtttag

SEQ ID NO: 372600 - DNA, 723 bp, Homo sapiens
  misc_feature: GZ8MTXP02IVS6Z.15.67.G01.1.454.CMB.2.raw
  modified_base (308)..(308): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgtgggttttcctgttgttatttagaaggtgtccagtgtgaggtgcacttggtggagtcgtgggggagcttggtccaggccggggggtccctgagcctctcctgtgcagtctcgtggacttctacccttagtaagttagtggatcgaccgtcggtccncgaggcctccgaggggacgggcgtggaggttgggtacggacccaaaagtaactaaaacgaaaggaaacgggtaacgtaacgaaagtaaaaaccgtgtacggtacggaccttcgttagtaacgggaccgggtccgtacttaccgaaccctagtcccgtaccgtaagaacgaaaccaaaccggacccgaaaagtaacgtttacaacgttgttaacgtttacgaacgtaaaagttccggaaaactcgttacccggaggaacggtacggggtacgaccgggaaccgtccgggtaccggttagttaacgtttagtttacggcgaccggtacgtaggtagtaggtaacgttaaacggtaccgtaaacgttcctaacggtaagtacggacgtaggggttaacgttacgtagtacgtttacgg

SEQ ID NO: 372601 - DNA, 625 bp, Homo sapiens
  misc_feature: GZ8MTXP02G52C0.15.67.G01.1.454.CMB.2.raw
  modified_base (384)..(384): a, c, t, g, unknown or other
  modified_base (445)..(445): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagctgggttttcctgttgttattttagaaggtgtccagtgtgaggtgcacttggtggagtcgtgggggagcttggtccaggccgggggggtccctggagactctcctgtgcagtctctggattcacccttagaagttacttggatgaacctgggtccgacaggctccgaggggaaggggctggagtgggtggaccaaacgaataaaacgaaagaccggaaagtcaagaaaaaactntgtgacttcagtgacggcgaattcaccaatctaccgaagacacaaacgccaaagaaacttnactcgttattgacgaaatgaaacagccgtagagagggtacgaacgggacgaacggtacccgttaggttaactttaagttcggtacggccgtaggaacgtagttaggaaacgttaaaggtaccgacgttacgaaacgtaagtacggactacgggggttaggtttaaatccggtaatttcgg

SEQ ID NO: 372602 - DNA, 751 bp, Homo sapiens
  misc_feature: GZ8MTXP02GAKTF.15.67.G01.1.454.CMB.2.raw
  modified_base (276)..(276): a, c, t, g, unknown or other
tcagtctacgtagccacgaccggtgctcgatttagagtatacatattgggtttgaggtctcagagaggagccttagccctggactccaaggcctttccacttggtgatcagcactgagcacagaggactcaccatggagttggggctgagcgttgggttttcctttgttgttattttagaaggtgtccagtgtgaggtgcacgttggtggagtcggtgggggaggtcgttggtccgacgggcccgggggggtccctggacgtactctccgtgtgcngtctcgtggtacttccaaccttagtagttatggtatgaccgtgggtccgccaggcctaccggaggggaaggggcgtgggaggtggggtcgaccaaacaacgtaaaacgaaaacggaacggaaagtaacgaaaacgaaaaagttacgtagtacgggtaacttcgtacgggtaacggtaccgggaccggtaactttacccaaacctcttacccgaccaaggaaccgaaccaaacccggaccaaaacggtaacttacgtacttacgtttaaacgtttacgaaactaaaacgttcggaaaaccgttacggtacccgtaggacggggaagggaccggggaacgggaaccgtaccggggtaccgtttaggttaaccgtttggttcggtacggccggtaggacgtagtagggtaacttaaggtaccgttactaaccgtagtaaggttaccggaggtacgggtagtaacgttggtacgtttgg

SEQ ID NO: 372603 - DNA, 792 bp, Homo sapiens
  misc_feature: GZ8MTXP02JJFTB.15.67.G01.1.454.CMB.2.raw
tcagtctacgtagccacgaccggtgctcgatttagagtatacatattgggtttggaggtctcagagaggagccttagccctggactccaaggcctttccacttggtgatcagcactgagcacagaggactcaccatggagttggggctgagctgggttttccttgttgttattttagaaggtgtcctagtgtgaggtgcacttggtggagtcgtgggggaggtcgttggtcccgaggcccggggggggttcccctgaggaccttctcctggtgcctagtctcttggattcacccgttagaagttattggactgaccctgggtaccgccacggctccggaggggtaacggggctagggacggtggggtggaccaaacgattaaaaccaaaggaccggaaagtcaacggtaaaaaaacccttgtacgttacgggaacttccggtacggttcgaaccggggtcccgtaacttcgaaacccccgtaagttcccctacccgaacggagaaacccgaaacggttaacccccaaaaggtaaaaactttccaaaccggttcgtttaagttttacgggaccttaaaaaacgtaagggtaaaaccgtaaacaaacccgttcggtaacgggaagggaacgggaaacgggtaaaccccggtaaccgggaccccggttacggggttacgtttaaaactttacgtttaggtcccggtacggtacggaagttacggacgtaacgtagtaaacgtaccgttaccgaacgttaggtaccgacggtaggtaacgttacggttacgttacg

SEQ ID NO: 372604 - DNA, 596 bp, Homo sapiens
  misc_feature: GZ8MTXP02FRJY0.15.67.G01.1.454.CMB.2.raw
  modified_base (323)..(323): a, c, t, g, unknown or other
  modified_base (335)..(335): a, c, t, g, unknown or other
  modified_base (348)..(348): a, c, t, g, unknown or other
  modified_base (386)..(386): a, c, t, g, unknown or other
  modified_base (392)..(392): a, c, t, g, unknown or other
  modified_base (459)..(459): a, c, t, g, unknown or other
tcagtctacgtagccacgaccggtgctcgatttagagtatacatattgggtttgaggtctcagagaggagccttagccctggactccaaggcctttccacttggtgatcagcactgagcacagagactcaccatggagttgggctgagctgggttttccttgttgttattttagaaggtgtccagtgtgaggtgcacgttggtggagtcgtggggggaggcttgggtccgacgggccggggggggttcccctggacgacgttctcctgtagcagtctctggattcaccttagaagttatggatgactggcccgcgaggctcgngggagggctggnggtggcgaccaanaataaacgaaagcggaagtacaaagaaaaccctgtagngactcnggtagacgccgaattcaccatccacagagacacgacaagatgactgttattagacaaaagtacaaancgtacaggagagggtacggaggacccgacggcgttagttaattacgtgtacgcggacgtagagttacgagttaaaggactacgactaaaccgtaaggaaccgtaggtaacgggtaggtttaaactaggtacgttcgg

SEQ ID NO: 372605 - DNA, 440 bp, Homo sapiens
  misc_feature: GZ8MTXP01CJ0CF.25.30.C08.1.454.CMB.2.raw
  modified_base (433)..(440): a, c, t, g, unknown or other
tcagactgtacagtcacgaccggtgctcgatttagtctgacgtcaaagggaaagggctggagtggctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctggaaaaagtcgtagtctcattcccgtgacctctggggccagggcaccctggtcaccgtctcctcagcttccaccaagggcccatcggtctccccctggcgcccctgctcccaggacgcacctctgggggcaccagcggccctgggctgcctggtcaagggctactccactgtacagtctgagcgggctggcaaggcgcatagnnnnnnnn

SEQ ID NO: 372606 - DNA, 451 bp, Homo sapiens
  misc_feature: GZ8MTXP01EL4HD.25.30.C08.1.454.CMB.2.raw
  modified_base (155)..(155): a, c, t, g, unknown or other
  modified_base (234)..(234): a, c, t, g, unknown or other
  modified_base (241)..(241): a, c, t, g, unknown or other
  modified_base (265)..(265): a, c, t, g, unknown or other
  modified_base (276)..(276): a, c, t, g, unknown or other
  modified_base (289)..(289): a, c, t, g, unknown or other
  modified_base (358)..(358): a, c, t, g, unknown or other
  modified_base (371)..(371): a, c, t, g, unknown or other
  modified_base (379)..(379): a, c, t, g, unknown or other
  modified_base (434)..(451): a, c, t, g, unknown or other
tcagactgtacagtcacgaccggtgctcgatttagtctgacgtcaaagggaaagggtcaccctctcctgcagggccagtcagagtgttggccgcaactacttagcctggttccagcagaaaactggcgagactcccagactcctcatccatggtncatccagcagggccactggcattccagacaggttcagtggcagtgggtctgggacagacttcactctcaccatcatganactggancctgagattctgcagtgtattacngtcagcagtangctagttcacctntgacgttcggaccaaagggaccaaaggtagaaaatcgaaaacgaactggtaggctgcaaaccatccttntctcactcctccnctatctanaactgtaactagtcgtaggacggtcgggacgtacggacgaacggctacaagtagnnnnnnnnnnnnnnnnnn

SEQ ID NO: 372607 - DNA, 502 bp, Homo sapiens
  misc_feature: GZ8MTXP01EO4P7.25.30.C08.1.454.CMB.2.raw
  modified_base (481)..(481): a, c, t, g, unknown or other
  modified_base (484)..(484): a, c, t, g, unknown or other
  modified_base (486)..(502): a, c, t, g, unknown or other
tcagactgtacagtcacgaccggtgctcgatttagtctgacgtcaaagggaaaggggctggagtggctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcgaggagtggctaggaaaaagtcgtagtctcattcccgtacgacctcgtcgggggccaggggccacccgtggtcaccgtctcctcactcctccaacccgaagggccccagtccggttcccttcccccgtcggccgccccgtgacctcccgaggtacgcctacccgtcgtgggggccaccgacggtcgcccgtggacctgccctgggtaccaaagtctacttccgacgtctacgagtctggagcgggctggacgtagccganagngnnnnnnnnnnnnnnnnn

SEQ ID NO: 372608 - DNA, 425 bp, Homo sapiens
  misc_feature: GZ8MTXP02HWLHT.25.30.C08.1.454.CMB.2.raw
  modified_base (319)..(319): a, c, t, g, unknown or other
  modified_base (336)..(336): a, c, t, g, unknown or other
  modified_base (398)..(398): a, c, t, g, unknown or other
  modified_base (402)..(402): a, c, t, g, unknown or other
  modified_base (423)..(425): a, c, t, g, unknown or other
tcagactgtacagtcacgaccggtgctcgatttagtctgacgtcaaagggaaagggctggagtgggttggccgtattaagaccaatagtgaaggtgggacaagagactacgctgcatccgtgaaagacagattcaccatctcaagggatgattcaaagaccacgctgtatctgcagatgaacagcctgaaggtagaggacacagccgtttattactgtacctcctttgaaagcaactcgggggactactggggccagggaaccctggtcaccgtctcctcagcctccaccaagggccccatccggtctccccctggccncccctgcctccaggacncacctccgagagcacagccggccctgggccctgccctggtcaaggcctacttccactgtacngtcngagcgggctgcagcgcatagnnn

SEQ ID NO: 372609 - DNA, 422 bp, Homo sapiens
  misc_feature: GZ8MTXP02JSKM2.25.30.C08.1.454.CMB.2.raw
  modified_base (311)..(311): a, c, t, g, unknown or other
  modified_base (411)..(411): a, c, t, g, unknown or other
  modified_base (417)..(422): a, c, t, g, unknown or other
tcagactgtacagtcacgaccggtgctcgatttagtctgacgtcaaagggaaagggctggagtgggttggccgtattaagaccaatagtgaaggtgggacaagagactacgctgcatccgtgaaagacagattcaccatctcaagggatgattcaaagaccacgctgtatctgcagatgaacagcctgaaggtagaggacacagccgttattactgtacctcctttgaaagcaactcgggggactactggggccagggaaccctggtcaccgtctcctcagcctcaccaagggcccatcggtcttcccccnggcgcccctgctccaggagcacctccgagagcacagcggcccctgggcctgcctgtcaaggcctattccactgtaccagtctgagcgggctggcaaggcncatagnnnnnn

SEQ ID NO: 372610 - DNA, 425 bp, Homo sapiens
  misc_feature: GZ8MTXP02I1BA9.25.30.C08.1.454.CMB.2.raw
  modified_base (254)..(254): a, c, t, g, unknown or other
  modified_base (291)..(291): a, c, t, g, unknown or other
  modified_base (407)..(407): a, c, t, g, unknown or other
  modified_base (415)..(425): a, c, t, g, unknown or other
tcagactgtacagtcacgaccggtgctcgatttagtctgacgtcaaagggaaagggccaccctctcctgcagggccagtcagagtgttggccgcaactacttagcctggttccagcagaaaactggcgagactcccagactcctcatccatggtgcatccagcagggccactggcattccagacaggttcagtggcagtgggtctggggacagacttcactctcaccatcatgagactggagcctgaggattcngcagtgtattactgtcagcagtatgctagttcacctntgacgttcgccaagggaccaaggtgaaatcaaacgacctgtgctgcaccatctgtcttcattccttcccgcatcctgaaacctgtacagttctggagcgggctgggacaaggggcncaagtagnnnnnnnnnnn

SEQ ID NO: 372611 - DNA, 566 bp, Homo sapiens
  misc_feature: GZ8MTXP01DVVQE.38.40.D07.1.454.CMB.2.raw
  modified_base (237)..(237): a, c, t, g, unknown or other
  modified_base (276)..(276): a, c, t, g, unknown or other
  modified_base (434)..(434): a, c, t, g, unknown or other
  modified_base (455)..(455): a, c, t, g, unknown or other
tcagtcgatcacgtcacgaccggtgctcgatttagtgatagagcgtaacacagaggactcaccatggagtttgggctgagctgggtttcctcgttgctcttttaagaggtgtccagtgtcaggtgcagctgggtggagtcgtgggggaggcgtggtccagccgtggggaggtccctgagactctcctgtacagcctctggattcactttctatagttatggcatgcacgtgggtccnccaggctccgaggcgaagggggctggagtgggtgcaaanacatcgtatgatggacgtactgagcactatcgcagccctcggtggaaacgggccattcaaccatcctacccaggacgacgtactacccaaaaaagaacaacgaatgtaatactaacaaatgaaacagactagaaaccggaggacaggctgtagtatangtgagaaggagttgggctaanattattattactctacgtcttggactcgtggggcccaagggaccacggttcagttcgttccttccccacgccctaccaaccgaacggccccagtcccggttccttcccccg

SEQ ID NO: 372612 - DNA, 644 bp, Homo sapiens
  misc_feature: GZ8MTXP01D41JY.38.40.D07.1.454.CMB.2.raw
  modified_base (234)..(234): a, c, t, g, unknown or other
  modified_base (367)..(367): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtacagcctctggattcactttctatagttatggcatgcactgggtccncaggctccgaggcgaagggggctgggaggtggggtggacaacgtacatcgtatgatggacgtactgagcactatgcagcctcgtagaacgggccattccaccatcctcccagagacgattacccaaaagaacncgatgtaactactaacaaatcgaaacacgacctaggaaacccggaggaaccacggtacttgtagtaattacgtgtaggacgtaaaggtaggtttcggggactaactaattaatttaactttacgttaccttaacggtcttttagggaccgtttcggtcgggggaaccaaacgggggacctaccgggttcaacgtttccggttccccttccccgacggtccccttacccgaaccgtaaaccgggccccttacgttccccggtttccccgttccccccg

SEQ ID NO: 372613 - DNA, 604 bp, Homo sapiens
  misc_feature: GZ8MTXP01EI7K8.38.40.D07.1.454.CMB.2.raw
  modified_base (233)..(233): a, c, t, g, unknown or other
  modified_base (361)..(361): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtacagcctctggattcactttctatagttatggcatgcactgggtccnccaggctccaggcaagggggctgggagtgggtggcaactacatcgtatgatggacgtactgagcactatgcagcctccgtgaacgggccgattcaccatcctcccagagacgattacccaaaagaacncgatgatactaacaaatgaaacagacctaggaaaccggaggacacggactgtagtattactgtagcgaaggtagttggggacttaacatttaatttaactttacctttacgttaacgttcgtttggtaccgttcgtcgggggaaccaacggggacccgtacgggttctacgtttcgccccttccccaccggcccctccgaacccgaacggggccccttacgtcccgggttccctttccccccg

SEQ ID NO: 372614 - DNA, 570 bp, Homo sapiens
  misc_feature: GZ8MTXP01DHEXB.38.40.D07.1.454.CMB.2.raw
  modified_base (234)..(234): a, c, t, g, unknown or other
  modified_base (351)..(351): a, c, t, g, unknown or other
  modified_base (386)..(386): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtacagcctctggattcactttctatagttatggcatgcactgggtccnccaggctccaggcaaggggctggagtgggtgcaacacatcgtatgatggacgtactgagcactatgcagcctcgtgaaggcattcacatctacccagagacgattaccaaaagaacncgatgtaatctaacaaatgaacagcctagaaacgngacacgactgtgtatactgtgacgaagtgtggactacattattattacttctaacgtcgtttggacgtcgtcggggaacccgaaagggaccctacgggttactaacgttcgttcccttccccgacgtccctacccgaacccgtaaacggggtccccaagttccccgggttccctttccccccgg

SEQ ID NO: 372615 - DNA, 688 bp, Homo sapiens
  misc_feature: GZ8MTXP01BATNL.38.40.D07.1.454.CMB.2.raw
  modified_base (239)..(239): a, c, t, g, unknown or other
  modified_base (309)..(309): a, c, t, g, unknown or other
  modified_base (350)..(350): a, c, t, g, unknown or other
  modified_base (378)..(378): a, c, t, g, unknown or other
  modified_base (430)..(430): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtcgtggggggaggcgtggtccagcctgggaggtccctgagactctcctgtacagcctctggattcacttttctatagttatggcatgcacgtcggggtccnccaggcctccgagggcgaagggggctgggaggtggggtgacaactacatcgtatgatggaacgtctggancactagtgcagccctccggtaggaacgggcctattcaaccntccacccagagacgataccaaaagaacncgatagtaactactaaacaaatcgaaacacgaccgtaacgggaaaaccgggnggaaccacgggtcttaggttagttaacgttacgtggtaggaacggtaaaggtaggtttcggggacttaacgtaatttaactttaactttactttacgttaaccggttcgttttacggggaccgttcgggtcgggggtaaccctaaagggggttaccctacgggttctaacgttttcccgaccccgttccccgaggtccccctacccgaaaccgtacccgggggccccttacgggttccccggttccccgttccccccg

SEQ ID NO: 372616 - DNA, 635 bp, Homo sapiens
  misc_feature: GZ8MTXP01DYLUI.38.40.D07.1.454.CMB.2.raw
  modified_base (242)..(242): a, c, t, g, unknown or other
  modified_base (286)..(286): a, c, t, g, unknown or other
  modified_base (293)..(293): a, c, t, g, unknown or other
  modified_base (390)..(390): a, c, t, g, unknown or other
  modified_base (406)..(406): a, c, t, g, unknown or other
  modified_base (435)..(435): a, c, t, g, unknown or other
  modified_base (454)..(454): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtcgtggggggaggcgtggtccagccgtgggaggtccctgagactctcctgtacagcctctggatttctacttttctattagttatggcatgcacgtcgggtccnccaggcctccgaggcgaagggggctgggaggtgggtgacaacanatcgtangagtggacgtctgagcaactatcgcacgcccgtacggtaggaaacggccgtattaccaccactcctaccaggacgaacgtactacccaaaaagaacncgatagtatactaaanaaagtgaaacagaccgtaagaaaccgggngacaggtctgtatattcgngtgacgtaagtgtacgggataactatttaattacgttacttcgtacgttcgttacggacgttcggtcggggaacctaacgggaccctaggttctaacgtttccggttaccccttccccgacggtcccctacccgaaccgaacccgggtcccttacggttccccgttccccgtttccccccg

SEQ ID NO: 372617 - DNA, 655 bp, Homo sapiens
  misc_feature: GZ8MTXP01BZUTR.38.40.D07.1.454.CMB.2.raw
  modified_base (236)..(236): a, c, t, g, unknown or other
  modified_base (341)..(341): a, c, t, g, unknown or other
  modified_base (367)..(367): a, c, t, g, unknown or other
  modified_base (383)..(383): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtcgtggggggaggcgtggtccagcctgggaggtccctgagactctcctgtacagcctctggattcactttctatagttatggcatgcacgtgggtccncaggctccgaggcgaaggggctggaggtgggtgacaacacatcgtatgatggaacgtactgagcactatcgcacgcccgtcggtagaaggcctattccacatccncccagacgacgactaccaaaagaacncgatagtactactaanaatagaaacagaccgaaggaaaccggagacgacggctagtgtattacgtgtaggacgtaaggtaggttcggggacttaacgtaattaactttactttaaccgttacgttaccggttacgtttcggggtaccgttccgggtcgggggaacccgtaaacggggttacccgtacgggttccgtaacgtttccggttccccttccccgacgtcccctaccccgaacccggaaaccgggtccccgttaccgttccccggttccccgttcccccccgg

SEQ ID NO: 372618 - DNA, 662 bp, Homo sapiens
  misc_feature: GZ8MTXP01B15JL.38.40.D07.1.454.CMB.2.raw
  modified_base (233)..(233): a, c, t, g, unknown or other
  modified_base (357)..(357): a, c, t, g, unknown or other
  modified_base (400)..(400): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtacagcctctggattcactttctatagttatggcatgcactgggtccncaggcctccgaggcaagggggctggaggtgggtggcaacacatcgtatgatggacgtactgagcactatgcacgcctcgtgaaggccattcacatctacccagagacgactaccgaaaagaacncgatgtaactactaacaaatcgaaacacgcctaggaaaccggnggacacggctagtgtattacgtgaggacgaaggtggttacgggacttaacgaatttaactttacttaccgtttacgtacggttcgttttacgggtaccggttccggtcgggggaacccgtaaacgggggttaccccgtacggggttcctaaacggttttcccggaccccttccccccgaacggtccccccttacccgaaccccggtaaacccgggggtccccttaaccgggtttccccgggtttcccctttccccccccggg

SEQ ID NO: 372619 - DNA, 548 bp, Homo sapiens
  misc_feature: GZ8MTXP01B47VW.38.40.D07.1.454.CMB.2.raw
  modified_base (234)..(234): a, c, t, g, unknown or other
  modified_base (281)..(281): a, c, t, g, unknown or other
  modified_base (407)..(407): a, c, t, g, unknown or other
  modified_base (410)..(410): a, c, t, g, unknown or other
  modified_base (445)..(445): a, c, t, g, unknown or other
  modified_base (451)..(451): a, c, t, g, unknown or other
  modified_base (484)..(484): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtacagcctctggattcactttctatagttatggcatgcactgggtccncaggctccaggcgaaggggctgggagtgggtggcaactacatcgtangatggacgtatgagcactatgcagcctcgtagaaggccattccacatctacccagagacgatccaaaagaacaacgatgtatactaacaaatgaacagctaggaaaccgagacagctgtgtatacngtnacgtaagagttggacttaacattaattattacttntacgtntttgggactcgtggggaacaagggctacggttntacgttcttaccgttcccagtccctaccaaccgaacgggccccagttccggttcccttcccccg

SEQ ID NO: 372620 - DNA, 581 bp, Homo sapiens
  misc_feature: GZ8MTXP01AQ7PB.38.40.D07.1.454.CMB.2.raw
  modified_base (233)..(233): a, c, t, g, unknown or other
  modified_base (313)..(313): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtacagcctctggattcactttctatagttatggcatgcactgggtccnccaggctccaggcaagggggctggagtgggtggcaaactacatcgtatgatggacgtactgagcactatgcagcctccgngaaggccattcaccatctcccagagacgatcccaaaagaacaacgattgtactctaaacaaattgaaaccagtacccgaggaaaacccggggaggaaccgtacggactgttacggttacttacgtgtaggacggaaaggtacgttggggacttactattaattattacttctaacgtctttggacgtcgtggggaacctaagggcccaggttcattcgttccttccccagcccctccgaaccacgggcccagtccggttcctcccccg

SEQ ID NO: 372621 - DNA, 638 bp, Homo sapiens
  misc_feature: GZ8MTXP01BESEE.38.40.D07.1.454.CMB.2.raw
  modified_base (234)..(234): a, c, t, g, unknown or other
  modified_base (305)..(305): a, c, t, g, unknown or other
  modified_base (315)..(315): a, c, t, g, unknown or other
  modified_base (362)..(362): a, c, t, g, unknown or other
  modified_base (380)..(380): a, c, t, g, unknown or other
  modified_base (394)..(394): a, c, t, g, unknown or other
  modified_base (446)..(446): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtacagcctctggattcactttctatagttatggcatgcacgtgggtccnccaggctccgaggcgaagggggctgggaggtgggtggcaactacatcgtatgatggactactgagcactangcagcctcgngaaggccattcacatcaccccagacacgtacttacccgaaaagaacncgatgtaataccctaaanaaatcggaaaaccncgaaccgaacggaaaccgggagaccgtacggtacgttaggttactattacgnggtacggaacggtaaggtggttacggaacttaattaattaatttacttaccgttacgtacgttcgtttcgggacgttcgggacggggaaccgtaaacgggttacccgtacgttctacgttccgttccccttcccgacgtcccctacccgaaccggaccggtcccttaccggttccccgttcccgtaaccccg

SEQ ID NO: 372622 - DNA, 575 bp, Homo sapiens
  misc_feature: GZ8MTXP02G7Q10.38.40.D07.1.454.CMB.2.raw
  modified_base (353)..(353): a, c, t, g, unknown or other
  modified_base (430)..(430): a, c, t, g, unknown or other
tcagtcgatcacgtcacgaccggtgctcgatttagtgatagagcgtaacacagaggactcaccatggagtttgggctgagcgtggtttcctcgttgctctttaagaggtgtccagtgtcaggtgcagctggtggagtcgtgggggaggcgtggtccagcctgggaggtccctgagactctcctgtacagcctctggattcacttttctatagttatggcatgcactgggtccgccaggctccaggcaaggggctggagtggggtggcaactacatcgtatgatggacgtactgagcactatgcagcctcgtgaagggccattcaccatctcccagagacgattccaaagaacncgatgtatctaacaaatgaaacagcctagaaaccgagacacggctgtgtattactgtgacgaaggattgggacttanattattattacttctacgtcttttggacgtcgtcgggggaccaaaagggggacctaacgggtctaagtttcggtacccttcccccaagtccccttacccgaacccgaaacggggccccctaagttcccggtacctttccccccgg

SEQ ID NO: 372623 - DNA, 542 bp, Homo sapiens
  misc_feature: GZ8MTXP02HPD1S.38.40.D07.1.454.CMB.2.raw
  modified_base (339)..(339): a, c, t, g, unknown or other
  modified_base (372)..(372): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtacagcctctggattcactttctatagttatggcatgcactgggtccgccaggctccaggcaaggggctggagtggggtggcaactacatcgtatgatggacgtactgagcactatgcagcctccgtgaagggccattcaccatctccccaganacgattccaaagacacgatgtatctaacaaatnaaacagcctgaaaccggaggacacgctgtagtattactgtgacgaaaggattgggctacgattattattacttctacgtctttggacgtgtcgggggcctaaggggaccacgggtcattcgcctccccagccctccaaccgtaacggccctacgtccggttcttcccccg

SEQ ID NO: 372624 - DNA, 564 bp, Homo sapiens
  misc_feature: GZ8MTXP02FWNWY.38.40.D07.1.454.CMB.2.raw
  modified_base (408)..(408): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtacagcctctggattcactttctatagttatggcatgcactgggtccgccaggctccaggcaaggggctggagtgggtggcaactacatcgtatgatggacgtactgagcactatgcagcctcgtgaaggccgatcacatctcccagagacgattccaaagaacacgatgtatactaacaaatgaaacagcctagaaaccggagacacggctgtagtattacngtgacggaaaggagttgggctacgattattattacttctacgtctttaggacgttcgtggggaccaaggggaccacgggtacagtttcgtacccttcccccgaaggccccttcccgaacccgaacggggccccaagtcccggtcctttccccccgg

SEQ ID NO: 372625 - DNA, 564 bp, Homo sapiens
  misc_feature: GZ8MTXP02J2IY2.38.40.D07.1.454.CMB.2.raw
  modified_base (310)..(310): a, c, t, g, unknown or other
  modified_base (354)..(354): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtacagcctctggattcactttctatagttatggcatgcactgggtccgccaggctccaggcaaggggctggagtggggtgcaactacatcgtatgatggactactgagcactatgcagcctccgngaacgggccattcaccatctccccagagacgattccaaagaacncgatgtatctaacaaatcgaaacacgacctagaaaccggaggacacggctgtgtattactgtgacgaaggagttgggctacattattattacttactacgtcttacggtacgtcgtggggacccgaagggacccgacggtactacgttcgtccctccccgacgcccctaccgacccgaacggggcccctacgtcccggtcctttcccccg

SEQ ID NO: 372626 - DNA, 614 bp, Homo sapiens
  misc_feature: GZ8MTXP02I8CH7.38.40.D07.1.454.CMB.2.raw
  modified_base (233)..(233): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtacagcctctggattcactttctatagttatggcatgcactgggtccncaggctccaggcaaggggctggagtgggtggcaactacatcgtatgatggacgtactgagcactatgcagcctccgtgaacgggccattccaccatcctcccagacgacgattccaaagacacgatagtatctaacaaatcgaaacacgacctagaaacccgggaggaccacggcttgtattaagttactgtaggacggtaaaggtagttacgggactaactagttaactttattacctttctaacgtcgttttagggaccgttcggtcgggggtacccaaaaggggtaccctacggggtcctaagtttccgtccctcccccgaagtccccgtaccgaacccggtaacgggcccctacgtccccggtaccctttccccccg

SEQ ID NO: 372627 - DNA, 610 bp, Homo sapiens
  misc_feature: GZ8MTXP02JNH2E.38.40.D07.1.454.CMB.2.raw
  modified_base (234)..(234): a, c, t, g, unknown or other
  modified_base (307)..(307): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtacagcctctggattcactttctatagttatggcatgcacgtgggtccnccagggctccgaggcgaaggggctgggagtggggtggcaacgtacatcgtatgatggacgtactgagcactangcagcctcgtgaacgggccattcacctatcctacccagacgacgattaccgaaagaaccacgattacgtaatactaaacaaaatcgaaacacgacctaggaaacccggaggacgacgctgtagttattacgtgtcgacggtaaggtagttgggactaacgtattaatttaacttacttaccgtacgtcgtttgggaacgttcggtacggggaccgtaaacgggacctacgggttacacgttcgtcccgtaccccgagtccctacccgaaccgacgggccctacgttcccggtcccttcccccg

SEQ ID NO: 372628 - DNA, 602 bp, Homo sapiens
  misc_feature: GZ8MTXP02GG1SF.38.40.D07.1.454.CMB.2.raw
  modified_base (233)..(233): a, c, t, g, unknown or other
  modified_base (358)..(358): a, c, t, g, unknown or other
  modified_base (413)..(413): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtacagcctctggattcactttctatagttatggcatgcactgggtccnccaggctccgaggcaaggggctggagtgggtgcaactacatcgtatgatggacgtactgagcactatgcagccctcgtaggaacgggcctattccaccatctccccagacacgataccaaagacncgatagtatactaacaaatgaaacagacctacggaaacggagtacgacgctagtntaacgttactgtagacgtaaaggtcgttagggacttaacgaattaatttaactttacttactacgttcgtttaggacgttcgtacgggggaccaaaaggggacccgtacggtactacttccggtaccctcccccgtaacgcccctaccgaaccgtaaccgggccctacgtccggtcccctttacccccg

SEQ ID NO: 372629 - DNA, 558 bp, Homo sapiens
  misc_feature: GZ8MTXP02GSJPT.38.40.D07.1.454.CMB.2.raw
  modified_base (296)..(296): a, c, t, g, unknown or other
  modified_base (312)..(312): a, c, t, g, unknown or other
  modified_base (329)..(329): a, c, t, g, unknown or other
  modified_base (336)..(336): a, c, t, g, unknown or other
  modified_base (352)..(352): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtacagcctctggattcactttctatagttatggcatgcactgggtccgccaggctccaggcaaggggctgggagtggggtggcaactacatcgtatgatggacgtactgancactatgcagcctcgngaggccattcaccatcncccaganacgattaccaagaacncgatgtatctaacaaatgaaacagacctaggaaaccggagacacggctgtgttaattactgtagacggaaggagttcgggactactagttatttacttacttctacgtcgtttggacgtcgtggggacctaaagggaccacgggtcagtttcgtaccctcccagccctaccgaaccgacgggcccacgttcccggtccttcccccg

SEQ ID NO: 372630 - DNA, 600 bp, Homo sapiens
  misc_feature: GZ8MTXP02GZ3Q6.38.40.D07.1.454.CMB.2.raw
  modified_base (233)..(233): a, c, t, g, unknown or other
  modified_base (437)..(437): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtacagcctctggattcactttctatagttatggcatgcactgggtccnccaggcctccgaggcaaggggctgggagtggggtggacaaactacatcgtaatgatggactactgagcactatgcagcctcgtgaacgggcctattccaccattccacccagagacgtataccaaagaacacgtatgtaataccaaacaaaatcgaaacagacccgtaaggaaacccggaaggacacggctgttagtaattacngtagacgaaggattgggactagattatttaacttacttacgtacgtcgtttaggacgttcgtacgggggaccaaacggggccctaacggtctacgttccgtccctccccgaagtcccctacccaaccggtaacggcccctacgttccggttcccttcccccgg

SEQ ID NO: 372631 - DNA, 721 bp, Homo sapiens
  misc_feature: GZ8MTXP02I53LW.38.40.D07.1.454.CMB.2.raw
  modified_base (235)..(235): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtctgggggaggcgtggtccagcctgggaggtccctgagacctctcctgtacagcctctggattcactttctatagttatggcatgcacgtgggtccnccaggcctccaggcgaaggggctggagtggggtggcaactacatcgtatgatggactactgagcactatgcacgcctccggtagaaggggcctagttccaaccattccaccccgagaagaaccgtaactttacccgaaaagaaacctaccggtattacggttaaacttacctaaaccgaaaaattcgaaaaccacggacccgtaacggaaaacccgggacggaaaccacgggtactagggtacgtttaattacgtagtggaccgggtaaaggtacgttacggggacttaaccgtaatttaaacgtttaacgtttaaccttacgttaaccggttacgttttacgggaccggtttcggtacgggggaacccgaaaacgggggtaccctaacggggtactacgtttcggtccccttaccccgacgaaccccttaaccccgaaccggtaaccgggacccctaccgttcccggttaccctttcccccccgg

SEQ ID NO: 372632 - DNA, 594 bp, Homo sapiens
  misc_feature: GZ8MTXP02JW1IW.38.40.D07.1.454.CMB.2.raw
  modified_base (233)..(233): a, c, t, g, unknown or other
  modified_base (294)..(294): a, c, t, g, unknown or other
  modified_base (376)..(376): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtacagcctctggattcactttctatagttatggcatgcactgggtccnccaggctccaggcaaggggctggagtgggtggcaactacatcgtatgatggacgtactgancactatgcagcctccggtgaaagggccattccacctatctccccagacgacgacttaccaaagaacacgatagtatactaanaaatgaaacagacctagaaaccggagacacgctgtgtattacgtgtgacgaggagttgggactactattaattactttaccttactaacgtcgtttacggtacgtcgtcgggggtaccgaaacggggccaacgggtctagtttccgtcctacccccgtacgcccctacccgaacccgaaacggggtccctaccggttcccggtaccctttccccccgg

SEQ ID NO: 372633 - DNA, 692 bp, Homo sapiens
  misc_feature: GZ8MTXP02ID40L.38.40.D07.1.454.CMB.2.raw
  modified_base (210)..(210): a, c, t, g, unknown or other
  modified_base (238)..(238): a, c, t, g, unknown or other
  modified_base (274)..(274): a, c, t, g, unknown or other
  modified_base (291)..(291): a, c, t, g, unknown or other
  modified_base (302)..(302): a, c, t, g, unknown or other
  modified_base (306)..(306): a, c, t, g, unknown or other
  modified_base (377)..(377): a, c, t, g, unknown or other
  modified_base (443)..(443): a, c, t, g, unknown or other
  modified_base (462)..(462): a, c, t, g, unknown or other
tcagtcgatcacgtcacgaccggtgctcgatttagtgatagagcgtaacacagaggactcaccatggagtttgggctgagctgggttttcctcgttgcttcttttaagaggtgtccagtgtcaggtgcagctggtggagtcgtggggggagcgtggtccagcctgggaggtccctgagactctcctgtacagcctctggattctactttntatagttatggcatgctacgtgggtccnccgaggcctcgaggcgaaggggctgggaggtggggngacaaactcgatcgtangatggactacnggancatatgacacgtcccgtcggagacgggtcctatccaccatccaccccaagcgaccaattaccaaagaaccngtatataactataaaccgaaagtacaaaccacgtaccgaaacggaaaacccgaggtaaccgacgtntagttaagtactagttggngaagaggtagtggtacctataaactttatttaacgttacttactaacggtttcgtttacgggaacggtttaaccggcgggtaaacccgggaaaacggtccccggtaagtttaaccgtacggttttacccccgtaccccttaaccccgacccgtaacccccgtaaacccggaaccccggtacccgggttacccccgttacccggtttcccccggttacccccgtacccccg

SEQ ID NO: 372634 - DNA, 619 bp, Homo sapiens
  misc_feature: GZ8MTXP02J0NAW.38.40.D07.1.454.CMB.2.raw
  modified_base (398)..(398): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtcgtggggggaggcgtggtccagcctggggacggtccctgagactctcctgtacagcctctggattcactttctattagttatggcatgcacgtgggtccgcaggcctcgaggcgaaggggctgggagtggggtgacaactacgatcgtatgatggacgtactgagcactagtgcacgtcccgtccgtaggaacggccgtattccacctatcctccccgagaccgacgtattaccgaaagaacacgattgtaacactaanaaatgaaacacgaccgtaaggaaacccggaggaacgacggcgtagtgttaattacgtggtgaggaggtagtcgggtactataatttattaatttacttactacgttacgtttcgggtaccgtcggtacggggaccgacgggacctacggtcaagttcgtacccgtcccggatccccgtacgacccggaacggcccctacgttcccggtacccttcccccgg

SEQ ID NO: 372635 - DNA, 634 bp, Homo sapiens
  misc_feature: GZ8MTXP02HHP06.38.40.D07.1.454.CMB.2.raw
  modified_base (238)..(238): a, c, t, g, unknown or other
  modified_base (301)..(301): a, c, t, g, unknown or other
  modified_base (304)..(304): a, c, t, g, unknown or other
  modified_base (314)..(314): a, c, t, g, unknown or other
  modified_base (338)..(338): a, c, t, g, unknown or other
  modified_base (365)..(365): a, c, t, g, unknown or other
  modified_base (386)..(386): a, c, t, g, unknown or other
tcagtcgatcacgtcacgaccggtgctcgatttagtgatagagcgtaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtacagcctctggacttcacttttctaattagttatggcatgcactgggtccncaggcctccgaggcgaaggggctggagtggggtgcaacgtacagtcgtatgaatggactacgnganctatagcgcncgtcgtcgaggacgctatacactntccacgaagacactacaacgaagaacngtatataactaacaaactaanaacgaaacacgaccgtaaacggaaacggaggtacacgtatacggttagttaacgtgtgtagagtaagtggttacgtaactagttaacttaattacgttaccttagtacgttcgttacgggacgttcggtacgggaaccgtaaacggtccgtaacggtcttacggtacccgtaccgtcccggtaaccgtaaccccgtaccgaaaccggtacccggtacccgtcgttcccccggttcccccgttaacccg

SEQ ID NO: 372636 - DNA, 538 bp, Homo sapiens
  misc_feature: GZ8MTXP01ESJ8G.15.74.G08.1.454.CMB.2.raw
  modified_base (314)..(314): a, c, t, g, unknown or other
  modified_base (325)..(325): a, c, t, g, unknown or other
  modified_base (327)..(328): a, c, t, g, unknown or other
  modified_base (333)..(333): a, c, t, g, unknown or other
  modified_base (355)..(355): a, c, t, g, unknown or other
  modified_base (360)..(360): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttcacctgtctgcatctgtggagatagagtcaccatcacttgccggccagtcagagtattagtacctggttggcctggtatcagcagaaaccagggaaagcccctaaatcctgatgtataaggcatctagcttagaaagtggggtncatcagtcagngnngtgantgagagatcactctcacatcancaccncgcacgctgtatagtatttagtactaacttaacttacttagtactaactaataataaattaagttaaacttacgttcgtacggttacggtacgaacgggtaacggaaacggtaaggttaaagtaaacgtaaacgaaacgttacgttaggtcgtcgtcgactacttacttcgttcgttc

SEQ ID NO: 372637 - DNA, 538 bp, Homo sapiens
  misc_feature: GZ8MTXP01D5BKD.15.74.G08.1.454.CMB.2.raw
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcaagaaaccagggaaacgcccctaaactcctgatgtataaggcatctagcttagaaagtgggggtgccatcaaggttccagcggcagtggaatcgtgggacagaaattcactctcaccatcagcaccctgcagcctagatgtatttgactaacttattaactgtacaactagtaataattagtaaattccgtggtacgttcggccgaaagggaccaaagggtaggaaaataccgaaaacggaaaccttgttcgggctcggctacccattcctgttcttaacc

SEQ ID NO: 372638 - DNA, 532 bp, Homo sapiens
  misc_feature: GZ8MTXP01DT1NM.15.74.G08.1.454.CMB.2.raw
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggcagtcagagtattagtacctggttggctggtatcagcagaaaccagggaaacgcccctaaactcctgatgtataaggcatctagcttagaaaggtggggtgccatcaaggttcaggcggcagtggaatcgtgggacagaattcactctcaccatcagcaccctgcagcctgatgtattttgactaactttagttacttgtactaaactagttaataaattagttaaattccgtaggtacgttcggaccgtaaagggaccaaagggtacgaaagtacgaaacgaacgttggttaggctgcaccattctgttcttc

SEQ ID NO: 372639 - DNA, 524 bp, Homo sapiens
  misc_feature: GZ8MTXP01D4U19.15.74.G08.1.454.CMB.2.raw
  modified_base (192)..(192): a, c, t, g, unknown or other
  modified_base (317)..(317): a, c, t, g, unknown or other
  modified_base (384)..(384): a, c, t, g, unknown or other
  modified_base (504)..(504): a, c, t, g, unknown or other
tcagtctacgtagccacgaccggtgctcgatttagtagctctatcaggggcaggagtcagacccagtcaggacacagcatggacatgagggtccccgctcagctcctggggctcctgctgctctggctcccaggtgccaaatgtgacatccagatgacccagtctccttcaccctgtctgcatctgtggganatagagtcaccatcacttgccgggccagtcagagtattagtacctggttggcctggtatcagcagaaaccagggaaagcccctaaactcctgatgtataaggcatctagcttagaaagtggggtncatcaaggttccagcgcagtgaatctgggacagaaattcactctcaccatcagcaccctgcagcctntatagtattatactaacttacgttacttagtactaactaataataataagttaacttacgtcgtacgtcgacgtaacggaacgaaggtaagttaaagtaacgtaacgaacgttgttagtntgcacacttactcgttcgtc

SEQ ID NO: 372640 - DNA, 503 bp, Homo sapiens
  misc_feature: GZ8MTXP01A1GQ4.15.74.G08.1.454.CMB.2.raw
  modified_base (193)..(193): a, c, t, g, unknown or other
  modified_base (315)..(315): a, c, t, g, unknown or other
  modified_base (483)..(483): a, c, t, g, unknown or other
tcagtctacgtagccacgaccggtgctcgatttagtagctctatcaggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggccagtcagagtattagtacctggttggcctggtatcagcagaaaccagggaaagcccctaaatcctgatgtataaggcatctagcttagaagtgggtnccatcaaggttccagcggcagtggaatctgggacagaattcactctcaccatcagcacctgcagcctgatgatttgactaacttattactgtcaacagtataatagtaaattctggacgttcggccaaagggaccaaaggtggaaatacgaaacgaacgttgttaggntgcaccattctgttcttaac

SEQ ID NO: 372641 - DNA, 553 bp, Homo sapiens
  misc_feature: GZ8MTXP01DZXLW.15.74.G08.1.454.CMB.2.raw
  modified_base (196)..(196): a, c, t, g, unknown or other
tcagtctacgtagccacgaccggtgctcgatttagtagctctatcaggggggcaggagtcagacccagtcaggacacagcatggacatgagggtccccgctcagctcctggggctcctgctgctctggctcccaggtgccaaatgtgacatccagatgacccagtctccttccaccctgtctgcatctggtggganatagagtcaccatcacttggccgggccagtcagtagtattagtacctggttggcctggtatcagcaagaaaccagggaaacgcccctaaactcctgatgtataaggctatctagtacttagaaaggtggggtgacctatcgaaggtttccaggcggcgagtggaatcgtggggacagattcactctacaccatcacgcacctgacacgcctgactgtatttcactaactttattactgtactaactagtataatagtaaattcctagggaccttcgggacctaaagggaccaaagggtagaaagtacgtaaagaacgttgttacgggctggaacaccctattcctaagttcttaacc

SEQ ID NO: 372642 - DNA, 561 bp, Homo sapiens
  misc_feature: GZ8MTXP01BILZY.15.74.G08.1.454.CMB.2.raw
  modified_base (323)..(323): a, c, t, g, unknown or other
  modified_base (370)..(370): a, c, t, g, unknown or other
  modified_base (542)..(542): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagacagaaaccagggaaacgcccctaaactcctagatgtataaggcatctagcttaggaaagtggggtnccatcgaaggttccaggcgcagtgaatcgtgggacagaattcactcncaccatcagccaccctgcagtcctagactgtatttgacttaactttagttactgtactaaactagttaataaatagttaacttccgtagggtaccgttaccgggaccgtaaaggggaccaaaggggtacgaaagtaccgaaaacggttacgttggacggctcgaacctactnttaccgtcgttaacctccg

SEQ ID NO: 372643 - DNA, 510 bp, Homo sapiens
  misc_feature: GZ8MTXP01DK14V.15.74.G08.1.454.CMB.2.raw
  modified_base (194)..(194): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccggcagtcagagtattagtactggttggcctggtatcagcagaaaccagggaaacgcccctaaactcctgatgtataaggcatctagcttagaaagtggggtgccatcaaggttcaggcggcagtggaatctgggacagaattcactctcaccatcagcaccctgcagcctgatgtatttgactaacttattactgtacaatagtataatagtaaattccgtggacgttcggccctaaagggaccaaggtacggaaatacgaaagaacgttgttaggctagcacattctgttcttc

SEQ ID NO: 372644 - DNA, 526 bp, Homo sapiens
  misc_feature: GZ8MTXP01DKR0T.15.74.G08.1.454.CMB.2.raw
  modified_base (196)..(196): a, c, t, g, unknown or other
  modified_base (321)..(321): a, c, t, g, unknown or other
tcagtctacgtagccacgaccggtgctcgatttagtagctctatcaggggggcaggagtcagacccagtcaggacacagcatggacatgagggtccccgctcagctcctggggctcctgctgctctggctcccaggtgccaaatgtgacatccagatgacccagtctcccttccaccctgtctgcatctgtggganatagagtcacatcacttgccgggcagtcagagtattagtacctggttggcctggtatcagcaagaaaccgagggaaacgcccctaaactcctgatgtaataaggcatctagctagaagtggggtnccatcgaggttccaggcggcagtggaatcgtgggacagaattcactctcaccatcagcacctgcagctgatgatttgactaactttatactgtacaactagtaataattagtaacttcgtaggtacgttccggacgaagggacgaagggtagaaagtacgaaacgttaacgttggttacggctagcaccattctcgttccttaac

SEQ ID NO: 372645 - DNA, 618 bp, Homo sapiens
  misc_feature: GZ8MTXP01EXB64.15.74.G08.1.454.CMB.2.raw
  modified_base (194)..(194): a, c, t, g, unknown or other
  modified_base (257)..(257): a, c, t, g, unknown or other
  modified_base (588)..(588): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggcagtcagagtattagtacctggttggcctggtatcgganagaaacgaggaaacgaccctaaacctactgatagtataagacgatctagacttagtaaagggtaggggtggaccatacgtaacggttacgtacggacgggcgaggtaggacgtacgtggggtaacgaagtaaacttctacctcttaccaccaacttacagacctaaccccgtgcgaacgtccctgtagtagtattttcgactaaactttactttacgtacgttacaaactagttaattaagttaagttactttaccgtcggtacgttaccggaccgtaaggggaacctaagggttaggaaacttaacgaaacggtaacttggttggttcgngccaacctactcttcgtaacttttcaaccg

SEQ ID NO: 372646 - DNA, 506 bp, Homo sapiens
  misc_feature: GZ8MTXP01DYFDM.15.74.G08.1.454.CMB.2.raw
  modified_base (194)..(194): a, c, t, g, unknown or other
  modified_base (325)..(325): a, c, t, g, unknown or other
  modified_base (342)..(342): a, c, t, g, unknown or other
  modified_base (406)..(406): a, c, t, g, unknown or other
  modified_base (421)..(421): a, c, t, g, unknown or other
  modified_base (493)..(493): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccggcagtcagagtattagtacctggttggcctggtatcagacaagaaaccagggaaacgcccctaaaatcctagatgtaataaggctatctagacttaagaaagtggggtnccatcaaggtcaggcgnagtggaatcgtgggacagtaattcaactctacaccatcagccacctgacagcctgatgtatttnactaacttatacgtntacaatagtataatagtaattctggactcggccaaaggacaaggtacgaaatacaacgaattgttagctgcncattctcgttctc

SEQ ID NO: 372647 - DNA, 541 bp, Homo sapiens
  misc_feature: GZ8MTXP01DZGE5.15.74.G08.1.454.CMB.2.raw
  modified_base (193)..(193): a, c, t, g, unknown or other
  modified_base (317)..(317): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttcaccctgtctgcatctgtggganatagagtcaccatcacttgccggcagtcagagtattagtacctggttggcctggtatcagcagaaaccaagggaaacgcccctaaactcctgatgtataaggcatctagcttagaagtggggtnccatcaaggttcagcggcagtggaatcgtgggacagaaattcactctcacatcagcaccctgcagcctgatgtatttgactaacttattactgttacaatagtaataatagtaaacttcgtaggtacgttcggccgtaaagggtaccaaaggggtacggttaaagttaccgaaaacgttaacgttgttacgggtcttaggctaacccattccttgttctttccg

SEQ ID NO: 372648 - DNA, 531 bp, Homo sapiens
  misc_feature: GZ8MTXP01DAQ9T.15.74.G08.1.454.CMB.2.raw
  modified_base (196)..(196): a, c, t, g, unknown or other
  modified_base (270)..(270): a, c, t, g, unknown or other
  modified_base (281)..(281): a, c, t, g, unknown or other
  modified_base (320)..(320): a, c, t, g, unknown or other
  modified_base (432)..(432): a, c, t, g, unknown or other
  modified_base (511)..(511): a, c, t, g, unknown or other
tcagtctacgtagccacgaccggtgctcgatttagtagctctatcaggggggcaggagtcagacccagtcaggacacagcatggacatgagggtccccgctcagctcctggggctcctgctgctctggctcccaggtgccaaatgtgacatccagatgacccagtctccttccaccctgtctgcatctggtggganatagagtcaccatcacttgccgggcagtcagagtatagtactggtgctggtatcagcaagaaaccagggaaacncccctaaatcngatgtaataaggcatctagcttaaggaaaggtgggggtnaccatcgaaggttcccaggcggcaggtggaatcgtgggaacaggtaaacttcacttcacaccctatcaagccaccctgacagcctgattgtatttgactaacttattacgtntaacaatataataatagtaacttcgtaggtacgtcgacgaaagggacaagggtagaaactacgaacgttagttgacggntagcactattccttgttctc

SEQ ID NO: 372649 - DNA, 603 bp, Homo sapiens
  misc_feature: GZ8MTXP01D9EDX.15.74.G08.1.454.CMB.2.raw
  modified_base (194)..(194): a, c, t, g, unknown or other
  modified_base (275)..(275): a, c, t, g, unknown or other
  modified_base (328)..(328): a, c, t, g, unknown or other
  modified_base (351)..(351): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcacatcacttggccggcagtcagagttattagtacctggttcggctggtatcagacaagaaaccgagggaaacncccctaaactcctagatgtataaggcatctagacttaaggaaaggtgggggancctaagtcgaaggttccaggcgngaggtggaatcgtgggaacagtaacttcactctacacatcagccaccgtgacacgtccttagactgttactttgaaccttaatttagttacctagttaactaaacgttaagttaattaaagttaagttaacgtttccgtaaggggtaacccgttccgggaaccggtaaagggaaccgttaaagggtaacggaaaactacgaaaacgttaacgttggttacggctacgccaacctattacttcgttcttaacc

SEQ ID NO: 372650 - DNA, 522 bp, Homo sapiens
  misc_feature: GZ8MTXP01AB98H.15.74.G08.1.454.CMB.2.raw
  modified_base (194)..(194): a, c, t, g, unknown or other
  modified_base (317)..(317): a, c, t, g, unknown or other
  modified_base (333)..(333): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccggcagtcagatattagtacctggttggctggtatcagcagaaaccagggaaacgcccctaaatcctagatgtataaggctatctagcttaggaagtggggtncatcaagtccaggcgnagtggaatcgtgggacagtaattcactctacaccatcagcaccctgacagcctagtatgtattttcgactaaacttagttactgtaccaaagtatataatagtaacttcgtggtacgttcggacgtaagggacaagggtagaaactacgaaacgacgttgttaggctgaacacctattccttcgttctc

SEQ ID NO: 372651 - DNA, 548 bp, Homo sapiens
  misc_feature: GZ8MTXP01ALG4N.15.74.G08.1.454.CMB.2.raw
  modified_base (323)..(323): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtcctccttccaccctgtctgcatctgtgggagatagagtcacatcacttgccggcagtcagagtatagtacctggttgctggtatcagcaagaaaccagggaaacgcccctaaactcctgatgtaataaggcatctagacttaaggaaaggtgggggtanccatcgaaggttccaggcggcaggtggaatcgtgggacagtaattcactctacaccatcacgcacctgcagcctgatgtatttgactaacttattactgtacaatagtataatagtaacttcgtaggtaccgttcgggaccgaaaggggaccaaaggggtacgaaacgtaacgaaaacggttacgttggttgggaactgaacctactagttcttcgttcttaacg

SEQ ID NO: 372652 - DNA, 531 bp, Homo sapiens
  misc_feature: GZ8MTXP01CIW0O.15.74.G08.1.454.CMB.2.raw
  modified_base (324)..(324): a, c, t, g, unknown or other
  modified_base (406)..(406): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggcagtcagagtattagtacctggttgcctggtatcagacagaaaccagggaaacgcccctaaaactcctgatgtataaggcatctagcgtttaagaaagtgggggtnccatcaaggttccaggcggcagtggaatcgtgggactaagaattcactctacaccatcagcacctgcagcctgactgatttnactaacttagttactgtacaactagtataatagtaaacttcgtagtacgttcgaaccgtaagggaccaaaggtacggaaatacgaaacgttaacgttgaggctagcacattactcgttctttaac

SEQ ID NO: 372653 - DNA, 638 bp, Homo sapiens
  misc_feature: GZ8MTXP01CPRFD.15.74.G08.1.454.CMB.2.raw
  modified_base (197)..(197): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtggganatagagtcacatcacttgccggcagtcagagtattagtacctggttggctggtatcagacaagaaaccgaagggaaacacccctaaactctagaatgtaataaggctaatactagtacgtttaaagggaaaggtgggggtacacctaagttacgtaagggttccagggacggctagggtggaacttcgggtaaggggaaactaaggtaaacttccaactctacaaccatcacgccaccgtgacagtcctagtacttagttactttacgaacttaaactttagttaacttagtaacaaacgttaattaaataaagttagttaaacgttccgtaagggtaccgttacgggaaccgtaaaggggtaaccaaaggggttacgaaacttaaaccgaaacgttaacgttggttacggctagcctacgtattcctaagttctttaacc

SEQ ID NO: 372654 - DNA, 638 bp, Homo sapiens
  misc_feature: GZ8MTXP01AXYJU.15.74.G08.1.454.CMB.2.raw
  modified_base (194)..(194): a, c, t, g, unknown or other
  modified_base (258)..(258): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggccagtcagagtattagtacctggttggcctggtatcgganacgaaacgaacggaaaggaccctaaacctacctcgatagtataaggacgatactagtacgttagtaaaggtagggtggcactacgaaggttacgacgacggcgagtggagtcgtgggaacgagtaatcactctcacactcagcaccctgcagcctgtatcgtatttcgtacaaactttacttacttacgtactaaaccaagttaattaaattacgttaaactttaccgtcgggtaaccggtttaccggacccggtaaacgggggaaacccgtaaagggttaaggggaaaacttaaaccgaaaaaccgggtaaacgttgggtttcggggacttaacggacccaaccctaagttcccttaggttcccttttaaccgtaaccc

SEQ ID NO: 372655 - DNA, 575 bp, Homo sapiens
  misc_feature: GZ8MTXP01ER6NT.15.74.G08.1.454.CMB.2.raw
  modified_base (196)..(196): a, c, t, g, unknown or other
  modified_base (273)..(273): a, c, t, g, unknown or other
  modified_base (326)..(326): a, c, t, g, unknown or other
tcagtctacgtagccacgaccggtgctcgatttagtagctctatcaggggggcaggagtcagacccagtcaggacacagcatggacatggagggtccccgctcagctcctggggctcctgctgctctggctcccaggtgccaaatgtgacatccagatgacccagtctccttccaccctgtctgcatctgtggganatagatcaccatcacttgccggcagtcagtagtattagtacctggttgctggtatcagcaagaaaccgagggaaacncccctaaatcctgatgtataaggcatctagtacttaaggaaaggtgggggtanacctagtacgaaaggttccaggcggacgaggtggaatcgtggggaactaggtacttcactctacacctatcagccacctgcacgcctagattagtactttcgacttaactttattacgttagtaaccaaagtataattaagttacgttaacttccgtaggtacgttcggacgtaaagggaaccgttaaggtagaaataacgaaacgttacgttgttacggctagcctacctattcctaagttccttaac

SEQ ID NO: 372656 - DNA, 544 bp, Homo sapiens
  misc_feature: GZ8MTXP01EJGFJ.15.74.G08.1.454.CMB.2.raw
  modified_base (195)..(195): a, c, t, g, unknown or other
  modified_base (322)..(322): a, c, t, g, unknown or other
  modified_base (341)..(341): a, c, t, g, unknown or other
tcagtctacgtagccacgaccggtgctcgatttagtagctctatcaggggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccggcagtcagagtattagtacctggttggcctggtatcagcaagaaaccagggaaacgcccctaaactcctagatgtataaggcatctagcttaggaaagtggggtnccatcaaggttccagcggnagtggaatcgtggggacagtaattcaactctacaccatcagccacctgcagcctgatgatttgactaacttattactgtacaactagtaataattagtaaacttcgtaggtacgttccggaccgaaaggggaaccaaagggtacggaaactacgaaaaccgttagttggttggctagcctaacctattcttcgttctttaacc

SEQ ID NO: 372657 - DNA, 576 bp, Homo sapiens
  misc_feature: GZ8MTXP01EKYR1.15.74.G08.1.454.CMB.2.raw
  modified_base (196)..(196): a, c, t, g, unknown or other
  modified_base (249)..(249): a, c, t, g, unknown or other
  modified_base (318)..(318): a, c, t, g, unknown or other
  modified_base (357)..(357): a, c, t, g, unknown or other
  modified_base (371)..(371): a, c, t, g, unknown or other
tcagtctacgtagccacgaccggtgctcgatttagtagctctatcaggggggcaggagtcagacccagtcaggacacagcatggacatgagggtccccgctcagctcctggggctcctgctgctctggctcccaggtgccaaatgtgacatccagatgacccagtctccttccaccctgtctgcatctggtggganatagagtcaccatcacttgccgggcagtcagatatagtactggttgctggtancagcagaaaccagggaacgacccctaaactctgatgtaataaggcatctagacttaaggaaggtggggncagtcgaaggttccaggcggacaggtggaatcgtggganagaattcacttacncaccatacagccacctgcagcctgtatgtatttcgacttaatttacgttactgtaacaacgtaattaataaagtttaagtaacttccgtagggtaccgttccgggaaccggaaacgggtacgttaaagggtacggttaaaataaccgtaaaacgaacggttcgttagggcctagtaaccacctattccgttcgttccgtttaacc

SEQ ID NO: 372658 - DNA, 538 bp, Homo sapiens
  misc_feature: GZ8MTXP01CIWZA.15.74.G08.1.454.CMB.2.raw
  modified_base (194)..(194): a, c, t, g, unknown or other
  modified_base (269)..(269): a, c, t, g, unknown or other
  modified_base (323)..(323): a, c, t, g, unknown or other
  modified_base (523)..(523): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcacatcacttgccggcagtcagagtattagtacctggttggctggtatcagcaagaaaccagggaacncccctaaatcctgatgtataaggctatctagtacttaaggaaaggtgggggtanacctagtcgaaggttccaggcggcgaggtggaatcgtggggactagtaattcactctacacctatcagcacctgcacgcctgactgtatttgactaactttatactgtacaactagtaataatagttaacttccgtaggtaccgtcggacgaaaggggaccaaagggtacgaaatacgaaagacgttgttcggctgcacngttctcgttcttaac

SEQ ID NO: 372659 - DNA, 519 bp, Homo sapiens
  misc_feature: GZ8MTXP01AZDFT.15.74.G08.1.454.CMB.2.raw
  modified_base (269)..(269): a, c, t, g, unknown or other
  modified_base (313)..(313): a, c, t, g, unknown or other
  modified_base (417)..(417): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcacatcacttgccggcagtcagagtattagtacctggttgcctggtatcagcagaaaccagggtaaancccctaaatcctgatgtataaggcatctagcttagaagtgggtnccatcaaggttccagcggcagtggaatcgtgggacagaattcactcgtcaccatcaagcacctcgcacgcctgatagatttagtactaacttagttactgttanaactatataatagtaattactcgtacgtcgtcgaacggaccgaaggtaggaaagtacaacgaacgttagttgggtaactcgaacactacttactcgttcgtc

SEQ ID NO: 372660 - DNA, 543 bp, Homo sapiens
  misc_feature: GZ8MTXP01BBNZ4.15.74.G08.1.454.CMB.2.raw
  modified_base (197)..(197): a, c, t, g, unknown or other
  modified_base (278)..(278): a, c, t, g, unknown or other
  modified_base (329)..(329): a, c, t, g, unknown or other
  modified_base (377)..(377): a, c, t, g, unknown or other
tcagtctacgtagccacgaccggtgctcgatttagtagctctatcaggggggcaggagtcagacccagtcaggacacagcatggacatgagggtccccgctcagctcctggggctcctgctgctctggctcccaggtgccaaatgtgacatccagatgacccagtcctccttccaccctgtctgcatctggtggganatagagtcacatcacttgccgggcagtcagagtattagtaccgtggttggcctggtatcagacaagaaaccgagggaaacncccctaaatcctgatgtaataaggcatctagacttaaggaaagtgggggtnccatcgaaggttccaggcggcaggtgaatcgtgggacagtatcactcncaccatcacgccacctgcagcctgatgtatttgactaactttatactgtacaaactagtaataagttagttaattccgtagggtaccgttacggaccggaaagggtaaccgaaagggtacgaaatacgaaacgagttggagctgaacctacattcgtgttcttaac

SEQ ID NO: 372661 - DNA, 528 bp, Homo sapiens
  misc_feature: GZ8MTXP01BA1CA.15.74.G08.1.454.CMB.2.raw
  modified_base (194)..(194): a, c, t, g, unknown or other
  modified_base (323)..(323): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggcagtcagagtattagtacctggttggctggtatcagcaagaaaccagggaaacgcccctaaactcctgatgtaataaggcatctagcttaaggaaaggtggggtnccatcaaggttccaggcgcagtggaatcgtgggacagaattcactctcaccatcagcaccctgcagcctgatgtatttgacttaacttattactgtacaacgtatataatagtaattccgtaggtacgttcggaccgtaaagggaccttaagggtagaaatacgaaacgttacgttggttggctcgcactattctcgttcttaac

SEQ ID NO: 372662 - DNA, 511 bp, Homo sapiens
  misc_feature: GZ8MTXP01DR5D8.15.74.G08.1.454.CMB.2.raw
  modified_base (197)..(197): a, c, t, g, unknown or other
  modified_base (250)..(250): a, c, t, g, unknown or other
  modified_base (271)..(271): a, c, t, g, unknown or other
  modified_base (315)..(315): a, c, t, g, unknown or other
  modified_base (337)..(337): a, c, t, g, unknown or other
  modified_base (400)..(400): a, c, t, g, unknown or other
tcagtctacgtagccacgaccggtgctcgatttagtagctctatcaggggggcagggagtcagacccagtcaggacacagcatggacatgagggtccccgctcagctcctggggctcctgctgctctggctcccaggtgccaaatgtgacatccagatgacccagtctccttccaccctgtctgcatctggtggganatagagtcacatcacttgccgggcagtcagagtatagtactggttgctggtancagcagaaaccagggtaaacncccctaaatctgatgtataagcatctagcttaggaagtggggtnaccagtcaaggttccaggcggnaggtggaatcgtgggacagtaacttcactctcacagtcagcacctgcagccttgatgtatttnactaactttaggttactgtacaagtataataatagtaactcgtggtacgtcggccaaagggacaaggtagaaatacgaacgagttggttagctgcacattctgttcttaac

SEQ ID NO: 372663 - DNA, 567 bp, Homo sapiens
  misc_feature: GZ8MTXP01CVQST.15.74.G08.1.454.CMB.2.raw
  modified_base (197)..(197): a, c, t, g, unknown or other
  modified_base (269)..(269): a, c, t, g, unknown or other
  modified_base (320)..(320): a, c, t, g, unknown or other
tcagtctacgtagccacgaccggtgctcgatttagtagctctatcaggggggcaggagtcagacccagtcaggacacagcatggacatgagggtccccgctcagctcctggggctcctgctgctctggctcccaggtgccaaatgtgacatccagatgacccagtcctccttccaccctgtctgcatctggtggganatagagtcacatcacttgccggcagtcagatattagtactggttggctggtatcagcaagaaacagggaacncccctaaatctgatgtataaggcatactagacttaaggaaaggtgggggtnccaatcaaggttccaggcggcaggtggaatcgtgggacagaattcactctacacatcacgccacctgcagcctagatgtatttgactaactttattacgtgtaacaactaagttaataaagttagttaaacttccgtaggtacgttcgggaccgaaaggggtaaccaagggttacgaaagttaacgaaacggttaaacgttggttacgggaacttaggaaccaaaccttcgttacgttcgttccttc

SEQ ID NO: 372664 - DNA, 738 bp, Homo sapiens
  misc_feature: GZ8MTXP01EMJ6P.15.74.G08.1.454.CMB.2.raw
  modified_base (193)..(193): a, c, t, g, unknown or other
  modified_base (332)..(332): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctccaggtgccaaatgtgacatccagatgacccagtctccttccaccctgtctgcatctgtggganatagatcacatcacttgccgggcagtcagagtattagtaccgtggttggctggtatcagacaagaaaccgagggaaacgacccctaaactcctagatagtaataaggctatactagacgttaaggaaaggtgggggtanaccgatacgtaaagggttccaggtcggacgaggtggaattcgtggggaacaaggtaaacttcgaaccttctaccaaccctatacgacgtacccaacccgtgaccgtaacgtccttaggtaacttggttaacttttacgtaacttaaaaccgttttaattttaaacgttacggttaaacctaaaacgtaaaggtttaaacttaaaagtttaaacggtttaaaacctttcccggtttaacggggtaaccccggttttaccgggaaacccgggtaaaacggggtaaacccgttaaaagggggtaaacggttaaaaacgttaaaccgaaaaaaccgggttaaaccgttgggttacgggtcttacggaacccctaaccgtaacttccgttaacgtttaacccgtttaaccg

SEQ ID NO: 372665 - DNA, 553 bp, Homo sapiens
  misc_feature: GZ8MTXP01EADYT.15.74.G08.1.454.CMB.2.raw
  modified_base (320)..(320): a, c, t, g, unknown or other
  modified_base (334)..(334): a, c, t, g, unknown or other
  modified_base (337)..(337): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccggcagtcagagtattagtacctggttggctggtatcagcaagaaaccagggaaacgccccctaaactcctagatgtataaggcatctagcttagaaagtggggtnccatcaaggtcagnggnagtgaatcgtgggacagaattcactctcaccatcagcaccctgcagcctgatgtatttgactaactttagttactgtacaactagttaataattaagttaaacttccgtagggtaaccgttcggaccgtaaaggggtaaccaaaggggttaggaaaattaccgaaaacgaacgttggttacggtctggaaccaccctattcgttcgttctttaacc

SEQ ID NO: 372666 - DNA, 674 bp, Homo sapiens
  misc_feature: GZ8MTXP01EA69J.15.74.G08.1.454.CMB.2.raw
  modified_base (194)..(194): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcacatcacttgccggcagtcagtagtattacgtaccgtggttggcctggtatcgagacgaacgaaaccgaacgggaaacgaacccctaacctacgtgagtagtagaacgtcatacgttagacgttagtaagggtagggtgtaccatacgtaaggtttccgaggacgggacgtaggtaggtactacgtgggtaacgagttaaacgtctactactaccacgttacacaccggacctaacccgtggacctaacggcctttaggtaattgttaacgtttacttaaccttaaacctttagtttaccttaggtaacctaaacgtagttaaataagtttactaaacgtttcccgtagggttacggttaaccggccgtaaaacggggtaacgttaacgggtaaagttaaacgtaaaccaaacgggttaacttggttacgggcttaccggctaacggttaccttggtaactttccgttaacc

SEQ ID NO: 372667 - DNA, 519 bp, Homo sapiens
  misc_feature: GZ8MTXP01A8XNL.15.74.G08.1.454.CMB.2.raw
  modified_base (194)..(194): a, c, t, g, unknown or other
  modified_base (319)..(319): a, c, t, g, unknown or other
  modified_base (497)..(497): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggccagtcagagtattagtacctggttggcctggtatcagcagaaaccagggaaacgcccctaaactcctgatgtataaggcatctagcttagaaagtggggnccatcaaggttcagcggcagtggaatcgtgggacagaatcactctcaccatcagcacctgcagcctgatgtactttgactaattatactgtacaactagtataattagtaattccgtaggtacgttcggacctaaaggggaccaaagggtaggaaatacgaaacgaacgttggacgtntgcaccagttctgttcttaacc

SEQ ID NO: 372668 - DNA, 712 bp, Homo sapiens
  misc_feature: GZ8MTXP01D83BA.15.74.G08.1.454.CMB.2.raw
  modified_base (195)..(195): a, c, t, g, unknown or other
  modified_base (334)..(334): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctggtggganatagagtcacatcacttgccggcagtcagtagtattagtacctggttggacttggtatcagacaagaaaccaagggaacgacccctaaactcctagatgtaataaggctatctagtacgtttaaggaaaggtggggtancctaagtacgaaaggtttcccgaaggtcgggacgaagggttggaacgttacgtaacgggggtaactaaggttaaactttcccaacttacctaccaaccctactacgaaccggccaaccccgtggacctaacgggtcctaggtacttaggttaacttttacgaaccttaaacttttactttaaccgttagttaacctaaactaaggtttaaattaaagtttaacggttaaactttccggttaggggttaacccggtttaccggggaaccccggtaaaggggtaaacccggttaaagggtaaacgggttaaataaaccgtaaacggttaacgttgggttacgtaactagaacctacgattccgttaagttctttaacccg

SEQ ID NO: 372669 - DNA, 575 bp, Homo sapiens
  misc_feature: GZ8MTXP01BPIGQ.15.74.G08.1.454.CMB.2.raw
  modified_base (195)..(195): a, c, t, g, unknown or other
  modified_base (313)..(313): a, c, t, g, unknown or other
  modified_base (375)..(375): a, c, t, g, unknown or other
  modified_base (382)..(382): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatcgtgtggganatagatcacatcacttgccggcagtcagagtattacgtacctggtgctggtatcagcagaaaccaggaacacccctaatctgatgtataggctatactagacttaaggaagtggggtnactatcgtaacggttcaggcggacaggtggaaagtcgtggggaactagtaaattcaacttcncaacctntacacgccaccgtgcaggtcctgtactagtactttcgacttaactttactacgtgtaaccaagtataatacgttagttaacttcgtacgggtaccttacgggccgaaacgggtccttaaagggttacgaaacgtaccgtaaaacgttagttcgggttaggtaacctcgtaacctacgtattccttcgttcctc

SEQ ID NO: 372670 - DNA, 541 bp, Homo sapiens
  misc_feature: GZ8MTXP01DTC9C.15.74.G08.1.454.CMB.2.raw
  modified_base (197)..(197): a, c, t, g, unknown or other
  modified_base (271)..(271): a, c, t, g, unknown or other
  modified_base (331)..(331): a, c, t, g, unknown or other
  modified_base (357)..(357): a, c, t, g, unknown or other
  modified_base (444)..(444): a, c, t, g, unknown or other
  modified_base (518)..(518): a, c, t, g, unknown or other
  modified_base (530)..(530): a, c, t, g, unknown or other
tcagtctacgtagccacgaccggtgctcgatttagtagctctatcagggggcaggagtcagacccagtcaggacacagcatggacatgagggtccccgctcagcctccgtggggctcctgctgctctggctcccaggtgccaaatgtgacatccagatgacccagtctccttccaccctgtctgcatctggtggganatagagtcacatcactgccggcagtcagatattagtactggtggctggtatcagacaagaaaccgagggaaacncccctaaagtcctagatgtaataaggctaatcgtaagtacgttaaggaaaggtggggtanaccagtacgaaggttccaggcggtanaggtggaatcgtaagggacagtaacttcactctacacatcgacgcacctgacagtcctagtactgtatttcacttaacttagtactntacaatataattaatagtaacttcgtagtcgtacggacgaaaggacttaaggtaagaaatacgaaagacgttgnggtcagcaactnttctcgttctc

SEQ ID NO: 372671 - DNA, 631 bp, Homo sapiens
  misc_feature: GZ8MTXP01DN2QZ.15.74.G08.1.454.CMB.2.raw
  modified_base (197)..(197): a, c, t, g, unknown or other
  modified_base (339)..(339): a, c, t, g, unknown or other
tcagtctacgtagccacgaccggtgctcgatttagtagctctatcaggggggcaggagtcagacccagtcaggacacagcatggacatgagggtccccgctcagctcctggggctcctgctgctctggctcccaggtgccaaatgtgacatccagatgacccagtcctccttccaccctgtctgcatcgtgtggganatagagtcacatcactgccgggcagtcagtagtattagtaccgtggttggcctggtatcagacaagaaaccaagggaaacgccccctaaaactcctagatagtataaggcaatctagtacgttaaggaaaggtgggggtacnccaatacgaaaggtttccgaggcggcgaggtggaaacttcgtggggaactaaggtaactttcactctacaaccatccacgtccacccgtgactacgcctagtacttgtactttagacttaaactttagttaccttagtaactaaacgtagttaaactaattagtttaaacttccgttaagggtaccgtttaccggggaccgtaaaacggggtaccgttaaagggtacggttaaaataaccgaaacgttaacgttggttacggctacgcctactattacgtcgtttcttaacc

SEQ ID NO: 372672 - DNA, 577 bp, Homo sapiens
  misc_feature: GZ8MTXP01CTQBH.15.74.G08.1.454.CMB.2.raw
  modified_base (560)..(560): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctcccttccaccctgtctgcatctgtaggagatagagtcacatcacgttcgccggcagtcagagtattagtacctggtgctggtatcagacaagaaacgaggaaactacccctaaactctgatagtaataaggctaagtctagtacgttaaggaaaggtcggggtacgaccaagtacgtaaggttaccgaggcggacgaaggtcgtaagtcgtggggaactagtaacttcactctacaccatacacgcctacctgacacgtcctagtacttgtatttgaacttaacttattacctagtacaagtaataataatagtaacttccgtagtaccgttcgaacgtaacggaacgaaaggtacgaaactacgaaacgttacgttgcggtcagaacctacgnttctaacgttctaaccg

SEQ ID NO: 372673 - DNA, 753 bp, Homo sapiens
  misc_feature: GZ8MTXP01COR3L.15.74.G08.1.454.CMB.2.raw
  modified_base (289)..(289): a, c, t, g, unknown or other
  modified_base (301)..(301): a, c, t, g, unknown or other
tcagtctacgtagccacgaccggtgctcgatttagtagctctatcaggggggcaggagtcagacccagtcaggacacagcatggacatgagggtccccgctcagctcctggggctcctgctgctctggctcccaggtgccaaatgtgacatccagatgacccagtcctccttccacctgtctgcatcgtggtgggagatagagtcacatctacgttcgccggcagtcagtagttatacgtcgtggtcgctgtatcagacgaagaaccgaagggaaaccacccctaaacnctagatagtaanaagctatacgtagtacgtttaaagggaaggtgggggtacaccgtaacgtacgtaaacggttccgaacggcggacgtaggtacggtaaagttccggtaagggggaactaaacgggtaaactttacccgtaacctacgtacccaacctacgtaccaacggtccccacccgtacgaccgacgttacccgtagttacgttacgttatttttacgacctttaaaacgtttttaacgttaacggtttaacgttaaacctaaacggtttaaagttaaatttaaaaccggtttaatttaaacccggtttccggtaacggggtttacccgggttaaccggaaacccggtaaaccggggtaaaggttaaacgggttaaacggaaacgttaaaccgaaacggttaacgttgggttacgttaaggaccgtaacctacgtcttaccggttcgttaacgttaaccc

SEQ ID NO: 372674 - DNA, 540 bp, Homo sapiens
  misc_feature: GZ8MTXP01EI2KQ.15.74.G08.1.454.CMB.2.raw
  modified_base (194)..(194): a, c, t, g, unknown or other
  modified_base (326)..(326): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccggcagtcagagtattagtactggtggctggtatcagcaagaaaccgaagggaaacgacccctaaactcctagatagtataaggcatctagcgttaagaaaggtgggggtancctatcgaaggttccaggcggcgaggtggaatcgtgggacaagtaattcaacttctcaaccatcacgccaccctgcacgcctagtatgtatttgacttaacttagtactgtacaagtataataattagtaattcgtaggtacgtcgtacgaaagggtacaagggtacggaaatacgtaaacgacgttgcggctagctacattctgttcttaacc

SEQ ID NO: 372675 - DNA, 612 bp, Homo sapiens
  misc_feature: GZ8MTXP01DS12Q.15.74.G08.1.454.CMB.2.raw
  modified_base (191)..(191): a, c, t, g, unknown or other
  modified_base (245)..(245): a, c, t, g, unknown or other
  modified_base (263)..(263): a, c, t, g, unknown or other
  modified_base (402)..(402): a, c, t, g, unknown or other
  modified_base (408)..(408): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctccaggtgccaaatgtgacatccagatgaccagtctccttccacctgtctgcatctgtggganatagagtcaccatcacttgccggcagtcagtatattagtactggtgctggtatnagcaagaaacgaggaacnccctaaactctagatgtaataagcatcgtagtactaaggaaaggtggggtacaccgaatacgaaaggttccaaggcggagtaaggtgggtaaatcggtaagggaactaaaggtaacttcaacttcacaaccatcaaccnccaccncgacgacgctagtagtagttagttacgtacttaacttaacgttacttacgtaactaacgtaagtaaagtaaagttaagttaacgttacgtacggtacgtacggtaacggaaacggtaaacggttaaacggtaaacgttaaacgtaaacgtaaacgttaacgttacgttacgtaacgtacgtaactactacttacttcgttcgtc

SEQ ID NO: 372676 - DNA, 597 bp, Homo sapiens
  misc_feature: GZ8MTXP01CG9CB.15.74.G08.1.454.CMB.2.raw
  modified_base (199)..(199): a, c, t, g, unknown or other
  modified_base (258)..(258): a, c, t, g, unknown or other
  modified_base (276)..(276): a, c, t, g, unknown or other
  modified_base (391)..(391): a, c, t, g, unknown or other
  modified_base (395)..(395): a, c, t, g, unknown or other
  modified_base (401)..(401): a, c, t, g, unknown or other
tcagtctacgtagccacgaccggtgctcgatttagtagctctatcaggggggcaggagtcagacccagtcaggacacagcatggacatgagggtccccgctcagctcctggggctcctgctgctctggctcccaggtgccaaatgtgacatccagatcgacccagtcctccttccaccctgtctgcatcgtggtggganatagagtcaccatcacgttcggccgggcagtcagtagtattacgtctggtggctggtancagcaagaacgaggaacnccctaactctagatgtatagctatactagtacgtaagggaaggtggggtacaccatacgtaagggtccagggcggagtaggtgaacgtgtgggactagaattcactctacactancacnccaccngaccagtctgtatgttattcacttaatttacttacgtacgtaactaaagtattaaacttaagttaacgttacgttcgtaacgggtaccgttacggaaccgggtaaacgggtaacgttagggtaaagaaacgttaacgaaacgttacgttcggttcgtaacgtacgtccctagtacttccttaacgttctttaaccg

SEQ ID NO: 372677 - DNA, 590 bp, Homo sapiens
  misc_feature: GZ8MTXP01BDD8I.15.74.G08.1.454.CMB.2.raw
  modified_base (361)..(361): a, c, t, g, unknown or other
  modified_base (397)..(397): a, c, t, g, unknown or other
  modified_base (402)..(402): a, c, t, g, unknown or other
  modified_base (425)..(425): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtcctccttccaccctgtctgcatctggtgggagatagatcacatcacttggccggcagtcagtagtattagtacgtggttggcctggtatcagacaagaaaccgaagggaaaccgcccctaaactcctgaatgtaataaggcagtactagtacttaagggaaaggtggggtacgccaatcgtaaggttccgaggcggngagtggaatcgtgggacagtaatcactctacacatnacgcncctgcacgcctagtatacggttntttacgtactaactttaacgtttactagttaacaaactaagttaattaaattagttaacgttccgtgggtaccgttcgggaaccgtaaagggtaaccgaaagggtacggaaagtaacgaaagttaccgttggttcggaactgaacacattcgtcgttcttaaccg

SEQ ID NO: 372678 - DNA, 568 bp, Homo sapiens
  misc_feature: GZ8MTXP01D2TI7.15.74.G08.1.454.CMB.2.raw
  modified_base (198)..(198): a, c, t, g, unknown or other
  modified_base (251)..(251): a, c, t, g, unknown or other
  modified_base (269)..(269): a, c, t, g, unknown or other
  modified_base (286)..(286): a, c, t, g, unknown or other
  modified_base (289)..(289): a, c, t, g, unknown or other
  modified_base (292)..(292): a, c, t, g, unknown or other
  modified_base (311)..(311): a, c, t, g, unknown or other
  modified_base (327)..(327): a, c, t, g, unknown or other
  modified_base (361)..(361): a, c, t, g, unknown or other
  modified_base (552)..(552): a, c, t, g, unknown or other
tcagtctacgtagccacgaccggtgctcgatttagtagctctatcaggggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtggganatagatcacatcactgccggcagtcagtagtattagtacctggttgctggatnagacagaaacgaggaacnccctaaatctgatgtanagnatntagataggaaggtgggtancatcgaagtcaggcgnagtgaatcgtggacagtacttcactcacacctancacgcaccgtgacgacgtcctagtacttgttatttcaacttaactttagggtaactgtaaactaaacgtattaaattaagttaagttaacgttccgtggtaaccgttccggaacggtaaacggaccgttaaagggtaacggttaaaactaccgtaaaaggaccgttgggttacgcgtcgtcaaacccgttnttacgtcttcgtaacc

SEQ ID NO: 372679 - DNA, 692 bp, Homo sapiens
  misc_feature: GZ8MTXP01BSMU2.15.74.G08.1.454.CMB.2.raw
  modified_base (335)..(335): a, c, t, g, unknown or other
  modified_base (377)..(377): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtcctccttccaccctgtctgcatcgtggtgggagatagagtcacatcacgttcgccggcagtcagattatagtaccgtggttggcctggtatcagcaagaaaccgagggaaacaccccgtaaatccgtagatagataaggctagtactagactttaaggaaggtgggggtanaccgtatcgaacggttcaggcggactaggtggaaacttcggngggactaaagtaacttcaacttcctaccaaacacgttaccaaggcccacccgtagaccgaacgtccgtaagtacgttaggttactttacggaactttaaaccgtttaacgttactttacggtaaacaaaccgtaaagtttaaattaaacttaaggtttaaaccgtttccgtacgggttaacccggttaccgggaaccggtaaaacgggggtaacccggttaaaagggttaaacggaaaaccgttaaaccgaaaagttaaaccgttggttacgaacttaccgaacgtaactacgttacttaacggtttctaacccg

SEQ ID NO: 372680 - DNA, 500 bp, Homo sapiens
  misc_feature: GZ8MTXP02G40AX.15.74.G08.1.454.CMB.2.raw
  modified_base (316)..(316): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggcagtcagagtattagtacctggttggcctggtatcagcagaaaccagggaaagcccctaaatcctgatgtataaggcatctagcttagaaagtgggtnccatcaaggtccagcgcagtggatcgtggggacagaattcactctcacatcagcaccctgcagcctgatgactttgactaactttattactgtacaactagtaataatagtaattcctaggtacgttcggcctaaagggaccaaggtcggaaaatcaaacgactgtggctgcacatctgtcttc

SEQ ID NO: 372681 - DNA, 506 bp, Homo sapiens
  misc_feature: GZ8MTXP02GWUMV.15.74.G08.1.454.CMB.2.raw
  modified_base (193)..(193): a, c, t, g, unknown or other
  modified_base (316)..(316): a, c, t, g, unknown or other
  modified_base (330)..(330): a, c, t, g, unknown or other
  modified_base (338)..(338): a, c, t, g, unknown or other
  modified_base (408)..(408): a, c, t, g, unknown or other
tcagtctacgtagccacgaccggtgctcgatttagtagctctatcaggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggccagtcagagtattagtacctggttggcctggtatcagcagaaaccagggaaagcccctaaatcctgatgtataaggcatctagcttagaaagtgggtncatcaagtcagcgnagtgatcngggacagaattcactctcaccatcagcaccctgcagcctgatgtatttgactaacttattactgtacaanatataaatagtaattcctaggacgttcggacctaaagggacccaaaggtggaaaatacgaaaacggtaactgtaggctgacacctatcctgtctttac

SEQ ID NO: 372682 - DNA, 495 bp, Homo sapiens
  misc_feature: GZ8MTXP02IWZ63.15.74.G08.1.454.CMB.2.raw
  modified_base (193)..(193): a, c, t, g, unknown or other
tcagtctacgtagccacgaccggtgctcgatttagtagctctatcaggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggcagtcagagtattagtacctggttggcctggtatcagcagaaaccaggaaagcccctaaatcctgatgtataaggcatctagcttagaaagtgggtgccatcaaggttccagcggcagtggatctgggacagaattcactctcaccatcagcaccctgcagcctgatgatttgactaacttattactgtacaacagtaataatagtaattcctggacgttcggacaagggaccaaggtaggaaatacaaacgaactgtaggctgcacatctagtcttc

SEQ ID NO: 372683 - DNA, 557 bp, Homo sapiens
  misc_feature: GZ8MTXP02J3LEP.15.74.G08.1.454.CMB.2.raw
  modified_base (313)..(313): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccggccagtcagagtattagtacctggttggcctggtatcagcagaaaccagggaaacgcccctaaatcctgatgtataggcatcagctagaagtgggtncatcaagtccagcgcagtgatcgtgggacagattcactctcacatcagcaccctgcagcctgatgtatttgactaactttgtactgtacaactagttaataattagtaaactttccgtagggaaccgtttacgggacctaaaacgggggaccctaaaggggttaggaaaacttaccgaaaacgggaaacctttggtaacggggccttacggaccaaccctaattccctaggttcctttaacccg

SEQ ID NO: 372684 - DNA, 544 bp, Homo sapiens
  misc_feature: GZ8MTXP02JQ0RQ.15.74.G08.1.454.CMB.2.raw
  modified_base (194)..(194): a, c, t, g, unknown or other
  modified_base (271)..(271): a, c, t, g, unknown or other
  modified_base (316)..(316): a, c, t, g, unknown or other
  modified_base (343)..(343): a, c, t, g, unknown or other
  modified_base (403)..(403): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggcagtcagagtattagtacctggttggcctggtatcagcagaaaccagggaaancccctaaatcctgatgtataaggcatctagcttagaaagtgggtnccatcaaggttccagcgcagtggatcnggggacagaattcactctcaccatcagcaccctgcagcctgattgtattttgtaaacttntttactgtacaaactagttaataaattagttaaattccgtaggtaccgttcggacaaaggggtacccaaaaggggttaggaaaacttacgaaaacgaacgtggtacggcttaaggcctaaccattctcgtacctttacacc

SEQ ID NO: 372685 - DNA, 493 bp, Homo sapiens
  misc_feature: GZ8MTXP02GXUU9.15.74.G08.1.454.CMB.2.raw
  modified_base (194)..(194): a, c, t, g, unknown or other
  modified_base (316)..(316): a, c, t, g, unknown or other
  modified_base (320)..(320): a, c, t, g, unknown or other
  modified_base (394)..(394): a, c, t, g, unknown or other
  modified_base (409)..(409): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggccagtcagagtattagtacctggttggcctggtatcagcagaaaccaggaaagcccctaaatcctgatgtataaggcatctagcttagaaagtgggtnccancaaggtccagcgcagtggatctggggacagaattcactctcaccatcgagctaacctgcagcctgatgtatttntactacttattactntacaacatataatataatactgtacgttcgacgaacggaccgaaggtagaagacaacgaactagtgcgcgacacactctctctc

SEQ ID NO: 372686 - DNA, 547 bp, Homo sapiens
  misc_feature: GZ8MTXP02JFYA4.15.74.G08.1.454.CMB.2.raw
  modified_base (194)..(194): a, c, t, g, unknown or other
  modified_base (273)..(273): a, c, t, g, unknown or other
  modified_base (323)..(323): a, c, t, g, unknown or other
  modified_base (341)..(341): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccggcagtcagagtattagtacctggttggcctggtatcagcaagaaaccgagggaaacncccctaaactcctagatgtaataaggcatctagacttagaaagtggggtnccatcgaggttccagcgnaggtgatcgtggggacaggtaattccactctacaccatcacgccaccctgacagcctgatgtatttgactaatttatactgtacaacgtataattaatagttaattcctaggtacgttacggaccgtaaagggaccaagggtacgaaaattacgaaaacgtaactggtaggaactacgaccgtaacctatccgtacgttctttacc

SEQ ID NO: 372687 - DNA, 522 bp, Homo sapiens
  misc_feature: GZ8MTXP02GO778.15.74.G08.1.454.CMB.2.raw
  modified_base (194)..(194): a, c, t, g, unknown or other
  modified_base (268)..(268): a, c, t, g, unknown or other
  modified_base (318)..(318): a, c, t, g, unknown or other
  modified_base (337)..(337): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccggcagtcagagtattagtacctggtgctggtatcagcagaaaccagggaaacncccctaaactcctgatgtaataaggcatctagcttaagaaaggtggggtnccatcgaaggttccagcgnagtggatcgtgggacagaattcactctcacatcagccaccctgcagcctgactgtatttgactaactttatactgtacaactagtaataatagttaattcgtggtacgttcggaacaagggaccgtaaagggtacggaaaatacgaaaacgaacgtggaggctacgactaccatctcgtacttac

SEQ ID NO: 372688 - DNA, 547 bp, Homo sapiens
  misc_feature: GZ8MTXP02GVYPY.15.74.G08.1.454.CMB.2.raw
  modified_base (317)..(317): a, c, t, g, unknown or other
  modified_base (332)..(332): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggctggtatcagcagaaaccagggaaacgcccctaaatcctagatgtataaggcatctagcttagaaagtgggncatcaagtccagcgnagtgatctggggacagaattcactctcaccatcagcacctgcagctgatgtatttgactaactttattactgtacaaactagtaattaaatagttaaattcccgtagggtaccgttcggacccgaaaaggggaccaaagggttaggaaaacttacgaaaacgtaaaccgtggtacggaacttacggaccctaaacacttacctacgttctttacc

SEQ ID NO: 372689 - DNA, 532 bp, Homo sapiens
  misc_feature: GZ8MTXP02G6KI3.15.74.G08.1.454.CMB.2.raw
  modified_base (194)..(194): a, c, t, g, unknown or other
  modified_base (322)..(322): a, c, t, g, unknown or other
  modified_base (341)..(341): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggcagtcagagtattagtacctggttggcctggtatcagcaagaaaccaggaaagccccctaaaatcctagatgtaataaggcatctagcttaagaaagtggggtnccatcaaggttccagcggnagtggatctggggacagaaattcactctcaccatcaagcaaccctcgcagcctgatagtatttatactaacttaattaacttagttacaacaataataaataataattactgtacgtacgtacgaacggaacgaaaggtaaggaaagtaacaaacgaaacgtagtagaacgtcgacacactactctacttc

SEQ ID NO: 372690 - DNA, 597 bp, Homo sapiens
  misc_feature: GZ8MTXP02IEWQM.15.74.G08.1.454.CMB.2.raw
  modified_base (196)..(196): a, c, t, g, unknown or other
  modified_base (332)..(332): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtcctccttccacctgtctgcattctggtggganatagagtcaccatcacttggccgggcagtcagtagttattagtacctggttggccttggtatcagcaagaaaccgagggaaacacccctaaatcctagatagtataaggcatctagacttaaggaaaggtgggganaccatacgaaggttccaggcggcaggtggatcgtggggactagtacttcactctacaccatcagccacctgccagctgattgtatttagaccttaactttattacttagtactaaactaagttaaataaagttacgttaaacttccgttaggtaccggttacggaaccgtaaacggggaaccgtaaagggtaacggaaaacgttacgaaaaccgtaacgttggtacggaacttacggaccaccgtatttcgtacgttacttaccg

SEQ ID NO: 372691 - DNA, 550 bp, Homo sapiens
  misc_feature: GZ8MTXP02HHGVR.15.74.G08.1.454.CMB.2.raw
  modified_base (274)..(274): a, c, t, g, unknown or other
  modified_base (325)..(325): a, c, t, g, unknown or other
  modified_base (392)..(392): a, c, t, g, unknown or other
  modified_base (394)..(394): a, c, t, g, unknown or other
  modified_base (398)..(398): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctggtgggagatagagtcaccatcacttgccgggccagtcagagtattagtacctggttggcctggtatcagcagaaaccagggaaacncccctaaatcctgatgtaataaggcatctagactttaagaaaggtggggtnccatcgaaggttccaggcggacaggtggatcgtggggacagtaattcacttcacaccatcagcaccncncacnctgatgtattatactaacttattactatactaactaataataataagttaacttacgtacggtacgtacggtacgtaacggaacggtaaaggtaacgtaaacgtaaacgtaaacgtaacgtacgtacgtcgtacgacactactctcttactc

SEQ ID NO: 372692 - DNA, 577 bp, Homo sapiens
  misc_feature: GZ8MTXP02HQ6A2.15.74.G08.1.454.CMB.2.raw
  modified_base (194)..(194): a, c, t, g, unknown or other
  modified_base (322)..(322): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggcagtcagagtattagtacctggtgcctggtatcagcagaaaccagggaaacgccccctaaactcctgatagtataaggcatctagacttaagaaaggtggggtncctatcaaggttccagcggcaggtggatcgtggggacaagaattcactctacacccatcagccaccctgcagcctgatgtattttgactaatttattactgtacaactagttaataattagttaacttccgtaggtacgttaccggacgaaacggggtaaccgaaaggggttaagaaaacttaccgaaaaacggtaacttaacggtcgggtaacctacggaacctacccgtaattccgtacggtttacctttacc

SEQ ID NO: 372693 - DNA, 538 bp, Homo sapiens
  misc_feature: GZ8MTXP02GZGZE.15.74.G08.1.454.CMB.2.raw
  modified_base (194)..(194): a, c, t, g, unknown or other
  modified_base (315)..(315): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggcagtcagagtattagtacctggtggcctggtatcagcagaaaccagggaaacgcccctaaatcctgatgtataggcatctagcttagaaagtgggtncatcaagtccagcgcagtgatcgtgggacagaattcactctacaccatcagccaccctgcagcctgatgtatttgactaactttatactgtaccaagagttaataaatagttaaattccgtaggtaccgttcggacccgtaaagggaccaaagggttacgaaaacgtacgaaaacggtaactgggtacggcttacggacctacctattcttcgttctttaacc

SEQ ID NO: 372694 - DNA, 511 bp, Homo sapiens
  misc_feature: GZ8MTXP02FL5EO.15.74.G08.1.454.CMB.2.raw
  modified_base (318)..(318): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggcagtcagagtattagtacctggttggcctggtatcagcagaaaccagggaaacgcccctaaatcctgatgtataaggcatctagcttagaaagtggggtnccatcaaggtcagcgcagtgatcgtgggacagaattcactctcaccatcagcacctgcagcctgatgatttgactaacttattactgtacaacagtaataaatagtaacttcgtaggtacgttcggacctaaaggggaccaaagggtacggaaaatacgaaaacgaactggtacgctgacacatctgtcttac

SEQ ID NO: 372695 - DNA, 544 bp, Homo sapiens
  misc_feature: GZ8MTXP02I9FUQ.15.74.G08.1.454.CMB.2.raw
  modified_base (317)..(317): a, c, t, g, unknown or other
  modified_base (369)..(369): a, c, t, g, unknown or other
  modified_base (371)..(371): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaacgcccctaaatcctgatgtataaggcatctagcttagaagtgggtncatcagtccagcgcagtgatcgtgggacagaattcactctcacatcagcccncncgcacgctgtagtgtattagtactaacttacttactatactaactaataataaattaagttaacgttacgtacggtacggtacggtacggtaacgggaacggtaaacggtaacggtaaacgtaacgtaaacgtaacgtagtacggtaacgtacgacactactactacgtactc

SEQ ID NO: 372696 - DNA, 537 bp, Homo sapiens
  misc_feature: GZ8MTXP02H9MAU.15.74.G08.1.454.CMB.2.raw
  modified_base (194)..(194): a, c, t, g, unknown or other
  modified_base (319)..(319): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccggccagtcagagtattagtacctggttggcctggtatcagcagaaaccagggaaacgcccctaaactcctgatgtaataaggcatctagcttagaaagtggggnccatcaaggttccagcgcagtggatctggggacagaattcactctcaccatcagcaccctgcagcctgatgtatttgactaacttattactgtacaactaagtataaatagttaaacttccgtaggtaccgttcgggaccctaaaggggaccctaaagggtacggtaaaactacgaaaacgaacgttggtacggctacgacacctatctcgtctttac

SEQ ID NO: 372697 - DNA, 527 bp, Homo sapiens
  misc_feature: GZ8MTXP02JPJC1.15.74.G08.1.454.CMB.2.raw
  modified_base (195)..(195): a, c, t, g, unknown or other
  modified_base (266)..(266): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctggtggganatagagtcaccatcacttgccggcagtcagagtatagtacctggtgctggtatcagcagaaacaggaaacncccctaactcctgatgtataggcatctagacttaaggaaaggtggggtcacctatacgtaaggtccaggcggacaggtgatcgtgggacagattcactctacacatcacgccaccgtgcacgcctagtactagtactttgactaactttattactgtacaactaagtataagtagtaacttcgtaggtacgtacgacgtaacggacgaaggtacgaaactacgaaacgtacgtagagcgtcgacactatctcgtacttacg

SEQ ID NO: 372698 - DNA, 582 bp, Homo sapiens
  misc_feature: GZ8MTXP02GDX42.15.74.G08.1.454.CMB.2.raw
  modified_base (194)..(194): a, c, t, g, unknown or other
  modified_base (268)..(268): a, c, t, g, unknown or other
  modified_base (314)..(314): a, c, t, g, unknown or other
  modified_base (334)..(334): a, c, t, g, unknown or other
  modified_base (342)..(342): a, c, t, g, unknown or other
  modified_base (346)..(346): a, c, t, g, unknown or other
  modified_base (374)..(374): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccggcagtcagagtattagtactggttgctggtatcagcagaaaccagggaaacncccctaaatcctgatgtataaggcatctagcttaagaagtggggtnccatacgaagtccagcgganagtgatgngganagtactcactcacacatcgacaccaccncgcacgctagtagtagttagttacgtacttaaactttaactttacttacgtactaaactaaagttaaattaaattaacgttaacgttacgttacggtaccggtacggtaaccggtaaacgggaaacggtaaacggtaaacggtaaacgtaaacgtaaacgtaaacgtacggtacgtaacgtacgacgactactacgtacgttacttac

SEQ ID NO: 372699 - DNA, 575 bp, Homo sapiens
  misc_feature: GZ8MTXP02GGL6L.15.74.G08.1.454.CMB.2.raw
  modified_base (272)..(272): a, c, t, g, unknown or other
  modified_base (322)..(322): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccggcagtcagagtattagtacctggttggcctggtatcagcaagaaaccagggaaacncccctaaactcctgatgtataaggcatctagcttaaggaaaggtggggtnaccatcgaaggttccagcggcaggtggatcgtggggacagtaattcactctcaccatcacgccaccctgcagcctagattgtattttgactaaatttaattactagtactaaactagttaaattaaagttaacgttaacttccgtagggtaccgttcgggaaccgtaaacggggacctaaagggtacggaaaataccgaaaacgaaccgttggtacggaacgtacgacctacctagttctcggttactttacc

SEQ ID NO: 372700 - DNA, 635 bp, Homo sapiens
  misc_feature: GZ8MTXP02H8FDX.15.74.G08.1.454.CMB.2.raw
  modified_base (194)..(194): a, c, t, g, unknown or other
  modified_base (252)..(252): a, c, t, g, unknown or other
  modified_base (331)..(331): a, c, t, g, unknown or other
  modified_base (354)..(354): a, c, t, g, unknown or other
tcagtctacgtagccacgaccggtgctcgatttagtagctctatcagggggcaggagtcagacccagtcaggacacagcatggacatgagggtcccccgctcagctcctggggctcctgctgctctggctcccaggtgccaaatgtgacatccagatgacccagtctccttccacctgtctgcatctggtgganatagagtcaccatcacgttgccgggcagtcagtagtattagtaccgtggtgctggtancagcaagaaaccagggaacgacccctaaactcctagattagtaataaggctatctagtacttaagggaaaggtggggtnacctagtcgaaggttccaggcgnaggtgatcgtggaacagtacttcactctacaccatcacgtcccacccgtgaccacgtcctaggattaggttacttttacgaacctttaactttaacgtttacttaacgtactaaaacgtaagtttaagtaaattaacggtttaaacttcccgttaagggtaccggtttccgggaaaccttaaaacggggaaccgtaaaggtaaacggtaaaactaaccggtaaaaacgtacgttggtaacggaacgttacgaacctaccgtaagttcctacgtttcctacc

SEQ ID NO: 372701 - DNA, 542 bp, Homo sapiens
  misc_feature: GZ8MTXP02IN6U3.15.74.G08.1.454.CMB.2.raw
  modified_base (194)..(194): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggccagtcagagtattagtacctggttgcctggtatcagcagaaaccagggaaaacgcccctaaactcctgatgtataaggcatctagcttagaaagtggggtgccatcaaggttccagcgcagtgatctggggacagaattcactctcaccatcagcaccctgcagccctgatgtatttgactaacttattactgtacaatagtataatagttaattcctaggtacgttacggaccgaaaacggggtaccaaaggggtcggaaaactacgaaaacgaaactggttacggcgttacggacctaaccgacttacgttcgtactttcc

SEQ ID NO: 372702 - DNA, 527 bp, Homo sapiens
  misc_feature: GZ8MTXP02FSY9P.15.74.G08.1.454.CMB.2.raw
  modified_base (194)..(194): a, c, t, g, unknown or other
  modified_base (272)..(272): a, c, t, g, unknown or other
  modified_base (320)..(320): a, c, t, g, unknown or other
  modified_base (339)..(339): a, c, t, g, unknown or other
  modified_base (368)..(368): a, c, t, g, unknown or other
  modified_base (375)..(375): a, c, t, g, unknown or other
  modified_base (380)..(380): a, c, t, g, unknown or other
  modified_base (387)..(387): a, c, t, g, unknown or other
  modified_base (389)..(389): a, c, t, g, unknown or other
  modified_base (406)..(406): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggcagtcagagtattagtacctggttggcctggtatcagcagaaaccagggaaacncccctaaactcctgatgtataaggcatctagcttaagaaagtggggtnccatcgaaggttcagcggnagtggatcgtgggacagtaattcacttcncacctancgacncctaccncncacgctgtatagtattntactaacttattactatactaataataataatatacttacgtacgtacgtacgacgaacggacgaaggtaacgtaaacgtaacgaacgtaacgtagtagtcgtcgacactactactctctc

SEQ ID NO: 372703 - DNA, 542 bp, Homo sapiens
  misc_feature: GZ8MTXP02FYREW.15.74.G08.1.454.CMB.2.raw
  modified_base (194)..(194): a, c, t, g, unknown or other
  modified_base (274)..(274): a, c, t, g, unknown or other
  modified_base (325)..(325): a, c, t, g, unknown or other
  modified_base (340)..(340): a, c, t, g, unknown or other
  modified_base (349)..(349): a, c, t, g, unknown or other
  modified_base (377)..(377): a, c, t, g, unknown or other
  modified_base (401)..(401): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggccagtcagagtattagtacctggttgcctggtatcagcaagaaaccaggggaaacnccccctaaaactcctgatgtaataaggcatctagcttaagaaagtggggtncatcaaggtcagcgnagtgatcgngggacagaattcactctacaccatcganccacctgcacgcctgatgtatttnactaacttatactgtacaaagtataataatacgtaattccgtaggtaccgttcggacccgtaaaagggaccgaaagggttaggaaaaactacgaaaacgtaacgtggtacggctacgacaacctatacgtctctttaaccg

SEQ ID NO: 372704 - DNA, 502 bp, Homo sapiens
  misc_feature: GZ8MTXP02ITV72.15.74.G08.1.454.CMB.2.raw
  modified_base (193)..(193): a, c, t, g, unknown or other
  modified_base (433)..(433): a, c, t, g, unknown or other
tcagtctacgtagccacgaccggtgctcgatttagtagctctatcagggggcaggagtcagacccagtcaggacacagcatggacatgagggtcccgctcagctcctggggctcctgctgctctggctcccaggtgccaaatgtgacatccagatgacccagtctccttccaccctgtctgcatctgtggganatagagtcaccatcacttgcccgggccagtcagagtattagtacctggttggcctggtatcagcagaaaccagggaaacgcccctaaactcctgatgtataaggcatctagcttagaaagtggggtgccatcaggttccagcgcagtggatctggggacagaattcactctcaccatcagccacctgcagccctgactgtatttgactaaacttatactgtacaacatataatatattcnggtacgtcgacgtaacggacgaaggtagaaatcaaaacgtacgtgtggcgtcgacactctctctcttac

SEQ ID NO: 372705 - DNA, 529 bp, Homo sapiens
  misc_feature: GZ8MTXP02INCDR.15.74.G08.1.454.CMB.2.raw
  modified_base (194)..(194): a, c, t, g, unknown or other
  modified_base (321)..(321): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggcagtcagagtattagtacctggttgcctggtatcagcaagaaaccagggaaacgcccctaaactcctagatgtaataaggcatctagcttaagaaagtgggtnccatcaaggttcagcgcagtgatcgtggggacagtaatcactctcacatcagcaccctgcagcctagactgtatttgactaaactttattactgtacaaactagtaataatagtaacttcgtaggtacgttcggactaacgggacaaagggtacgaaaatacgaaaacgtaacgtgacggaactgacctaccattctacgttcttacc

SEQ ID NO: 372706 - DNA, 499 bp, Homo sapiens
  misc_feature: GZ8MTXP02H81UK.15.74.G08.1.454.CMB.2.raw
  modified_base (194)..(194): a, c, t, g, unknown or other
  modified_base (250)..(250): a, c, t, g, unknown or other
  modified_base (267)..(267): a, c, t, g, unknown or other
  modified_base (310)..(310): a, c, t, g, unknown or other
  modified_base (326)..(326): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccacctgtctgcatctggtggganatagagtcaccatcacttgccgggcagtcagagtattagtacctggtggctggtancagcagaaacaggaacncccctaaatcctgatgtataaggcatctagcttagaagtgggnccatcaagtccagcgnagtgatcgtgggacagaattcactcacacatcagccacctgcacgcctagactgtatttgactaactttatactgtacaatagtataatagtaacttcgtggacgttcggacgtaaggaccgtaaggacgaaatacgaaaacgactgtagctgaccactactctcgttactac

SEQ ID NO: 372707 - DNA, 742 bp, Homo sapiens
  misc_feature: GZ8MTXP02IQUU7.15.74.G08.1.454.CMB.2.raw
  modified_base (195)..(195): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctggtggganatagatcaccatcacttggccgggcagtcagtagttattacgtaccgtggttcggccttggtatcgagacaaggaaaaccgagggaaaccgtaccccctaaacgtccgtagatagtaataaggctaagtcgtaagtacgtttaaagggaaacggttggggtacaccgtaagtaccggtaaagggtttcccgagggtaccggacgtagggttacgggtaacgttcggtagggggaacctaaaggtaaacctttacccgaaccttctaaccaaacccggtatacccgaaacgtcccaacccgtgacccgaacgtcccgttagtaattaggttacttttacgaaacctttaaacgttttacttaaccgttagtaactaaacggtaagtttaaattaaagtttaacggttaactttccggtaacgggttaacccggtttaccgggaaaccggtaaaacgggggaacccgttaaaggggttaacgaaaacttaaccgaaaacggtacgtggtacgcgttacgacctaccgtattccgttacgttacttaccg

SEQ ID NO: 372708 - DNA, 541 bp, Homo sapiens
  misc_feature: GZ8MTXP02JI8T2.15.74.G08.1.454.CMB.2.raw
  modified_base (194)..(194): a, c, t, g, unknown or other
  modified_base (272)..(272): a, c, t, g, unknown or other
  modified_base (397)..(397): a, c, t, g, unknown or other
  modified_base (528)..(528): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggcagtcagagtattagtacctggttgcctggtatcagcagaaaccgagggaaacncccctaaatcctagatgtaataaggcatctagacgttaagaaaggtggggtcgaccagtacgaaggttccagggcggactaggtggatcgtggggactaaggattccgaactctacaccatcganccactgcagcctagatgtatttgactaacttattactgtaccaatagttaataatagttacttcgtggacgttcgacgaagggtaccaagggtacgaaatacaaacgtacgtgtacggctacgtacaactntccgtattctacc

SEQ ID NO: 372709 - DNA, 545 bp, Homo sapiens
  misc_feature: GZ8MTXP02FITWC.15.74.G08.1.454.CMB.2.raw
  modified_base (194)..(194): a, c, t, g, unknown or other
  modified_base (322)..(322): a, c, t, g, unknown or other
  modified_base (371)..(371): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggcagtcagagtattagtacctggttggctggtatcagcaagaaaccaggaaacgccccctaaactcctgatgtaataaggcatctagcttaaggaaagtggggtnaccatacgtaaggtccagcggcagtggattcgtgggacagattcactcncacatcagccaccctgcacgcctagattgtatttcgacttaacttattactgtacaaactagtaataattagtaacttcgaggtacgttcggaacgaagggtaccgtaaaggtacggaaaactacgaaaacgtaacgtggtacggctacgacctacctatctacgttctttacc

SEQ ID NO: 372710 - DNA, 523 bp, Homo sapiens
  misc_feature: GZ8MTXP02JKELJ.15.74.G08.1.454.CMB.2.raw
  modified_base (194)..(194): a, c, t, g, unknown or other
  modified_base (291)..(291): a, c, t, g, unknown or other
  modified_base (318)..(318): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcacatcacttgccgggcagtcagagtattagtacctggttggcctggtatcagcaagaaaccagggaaacgcccctaaatcctgatgtanaaggcatctagcttagaaagtggggtnccatcaaggttccagcggcaggtgatcgtgggacagaattcaactctcacatcagcaccctgcacgcctgactgtatttgacttaattattacttgtacaactaagtattaagtattaacttctaggtacgttcgaccgaagggtaccaaagggtacgaaaatacaaaacgtactgtgaacgtagacaccatcgtcgtctttacc

SEQ ID NO: 372711 - DNA, 523 bp, Homo sapiens
  misc_feature: GZ8MTXP02IE4FO.15.74.G08.1.454.CMB.2.raw
  modified_base (194)..(194): a, c, t, g, unknown or other
  modified_base (290)..(290): a, c, t, g, unknown or other
  modified_base (316)..(316): a, c, t, g, unknown or other
  modified_base (332)..(332): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccacctgtctgcatctggtggganatagagtcaccatcacttgccggcagtcagagtattagtacctggttgcctggtatcagcagaaaccagggaaacgcccctaaactcctgatgtanaaggcatctagcttaagaaggtgggnccatcaaggtcagcgnaggtgatcgtggggacagaacttcactctacaccatcacgtccacctgcagcctgatgtattgactaactttatactgtacaatagtaataatagtattccgtggtacgtacgacgaaacggacaagggtacaaaacgtacgaaaacgtaacttggacggtcgtacgacactaagtcttacttacttaccg

SEQ ID NO: 372712 - DNA, 539 bp, Homo sapiens
  misc_feature: GZ8MTXP02G36DT.15.74.G08.1.454.CMB.2.raw
  modified_base (197)..(197): a, c, t, g, unknown or other
  modified_base (272)..(272): a, c, t, g, unknown or other
  modified_base (289)..(289): a, c, t, g, unknown or other
  modified_base (296)..(296): a, c, t, g, unknown or other
  modified_base (312)..(312): a, c, t, g, unknown or other
  modified_base (341)..(341): a, c, t, g, unknown or other
  modified_base (346)..(346): a, c, t, g, unknown or other
  modified_base (367)..(367): a, c, t, g, unknown or other
tcagtctacgtagccacgaccggtgctcgatttagtagctctatcaggggggcaggagtcagacccagtcaggacacagcatggacatgagggtccccgctcagctcctggggctcctgctgctctggctcccaggtgccaaatgtgacatccagatgacccagtctcccttccaccctgtctgcatctggtggganatagagtcaccatcacttgccggcagtcagagtattagtacctggtgcctggtatcagcagaaaccagggaaacncccctaatctgatgtanaggcatnagataggaagtgggtnacatacgtaaggtccaggcgcagtgatgnggganagattcactctacactatcanaccaccgtgccagcctagtactgttatttcgacttaactttattactagtactaaatataattaaatattaattcgttacggtaccgttcggaaccgtaaacgggacgtaaagggtacgaaaataccgaaacgtaacgtgtacggctcgactactatcgttacttacttacc

SEQ ID NO: 372713 - DNA, 529 bp, Homo sapiens
  misc_feature: GZ8MTXP02JBA8I.15.74.G08.1.454.CMB.2.raw
  modified_base (318)..(318): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggcagtcagagtatagtacctggtggcctggtatcagcagaaaccagggaaacgcccctaaatcctgatgtaataaggcatctagcttaagaaagtggggtnccatcaaggttccagcggcagtggatctggggacaggaacttcactctcaccatcagccacctgcagcctagatgtatttgactaaactttattactgtacaacgattaataatagtaacttcgtaggtacgttcgggactaaacgggaccgaagggtaacggaaatacgaaacgtaacgtgtagaacgtcgacaccattcctagtcttac

SEQ ID NO: 372714 - DNA, 562 bp, Homo sapiens
  misc_feature: GZ8MTXP02JUQNE.15.74.G08.1.454.CMB.2.raw
  modified_base (323)..(323): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagatatagtacctggttggcctggtatcagcaagaaaccagggaaacgcccctaaactcctagatgtaataaggcatctagcttaagaaaggtggggtnccatcaaggtccagcgcagtggatcgtgggacagtaacttcactctacaccatcagccaccctgcagcctagactgtattttcgactaaatttacttactgtacaaacgtagttaactaaagttagttacttcgtagggtaccgttacggaccgaaacggggtaccaaaggggtacgaaaacgttaccgaaaacggtacgttggtacggctacggaccacctagtcttacgtactttac

SEQ ID NO: 372715 - DNA, 540 bp, Homo sapiens
  misc_feature: GZ8MTXP02JAHPS.15.74.G08.1.454.CMB.2.raw
  modified_base (194)..(194): a, c, t, g, unknown or other
  modified_base (268)..(268): a, c, t, g, unknown or other
  modified_base (313)..(313): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccggcagtcagagtatgtacctggttgcctggtatcagcagaaaccagggaaacncccctaaatcctagatgtataaggcatctagcttagaagtgggtncatcaaggtccagcgcagtgatcgtggggacaggtaacttcgactctcaccatcacgcacctgcagccagtactgtatttcgactaacgtttatactgtacaacgtagtaactaagtagttaacttcgtaggtacgttcggacctaaaggggacctaaagggtacggtaaaatacgaaaacgtacgtggtacggaactcgacgtacctagttcgtacgtctttaccg

SEQ ID NO: 372716 - DNA, 653 bp, Homo sapiens
  misc_feature: GZ8MTXP02IUZJU.15.74.G08.1.454.CMB.2.raw
  modified_base (194)..(194): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcacatcacttgccggcagtcagagtattagtacctggttggctggtatcagcaagaaaccgagggaaacgacccctaaactcctagatagtaataaggcatctagacttaaggaaaggttggggtcacctagtacgtaaaggttccaggcggactaggtggatcgtggggacaagtacttcactctacaccatcacgtcccacccgtgaccgacgtcctaggtacttaggttacttttacggaacctttaaaactttttaacgttaacgtttacgttaaactaaacgttaaagtttaaattaaacgtttaagttaaactttcccggttagggttaaccgtttacggaacccgtaaaaggggacccgtaaaaggggtaacggaaaacttaaccggaaaacgtaaaccgttggtacggaacgtacgacctaacctagtccttacgttctttacc

SEQ ID NO: 372717 - DNA, 678 bp, Homo sapiens
  misc_feature: GZ8MTXP02HP9F1.15.74.G08.1.454.CMB.2.raw
  modified_base (197)..(197): a, c, t, g, unknown or other
  modified_base (380)..(380): a, c, t, g, unknown or other
tcagtctacgtagccacgaccggtgctcgatttagtagctctatcagggggcaggagtcagacccagtcaggacacagcatggacatgagggtcccccgctcagctcctggggctcctgctgctctggctcccaggtgccaaatgtgacatccagatgacccagtctcccttccaccctgtctgcatctggtggganatagagtcaccatcacttggccggccagtcagtagttattacgtaccgttgggttcggcctggtatcgagacaacggaaaaccgagggaaaccacccctaaactcgtgatagtaataaggctatctaagtacgttaaggaaacggtgggtacgacctagtaccgtaaggttccagggtccggngaggtggaattcgggaggggtaacaggtaattccctactctaccaacactcaccgaccaccccgtgacccagtccgttagtagttgttagtttacaactttaaacgtttacgtttacgttacgtaactaattaaagttaattaaactttaacgttaacgtttaccggtgggtttaaccggttaccgggaaacggtaaaacgggaaccgttaaaaggggtaacgtaaaaacttaacgaaaccggtaaacgtgtacggaattccgaacttaaccctagttcttaccgtttctttaacccg

SEQ ID NO: 372718 - DNA, 535 bp, Homo sapiens
  misc_feature: GZ8MTXP02FOMM2.15.74.G08.1.454.CMB.2.raw
  modified_base (194)..(194): a, c, t, g, unknown or other
  modified_base (265)..(265): a, c, t, g, unknown or other
  modified_base (275)..(275): a, c, t, g, unknown or other
  modified_base (316)..(316): a, c, t, g, unknown or other
  modified_base (336)..(336): a, c, t, g, unknown or other
  modified_base (420)..(420): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccggcagtcagagtatagtactggttgctggtatcagcagaaacaggaaacncccctaaacncctgatgtaataaggcatctagcttaaggaaaggtggggtnccatcgaaggttccagcganagtggatcgtggggacagtaattcactctacacatcacgccacctgcagcctagatgtatttgacttaacttatactgtacaanagttaaataattaagtacttcgtaggtacgttacggaccgaaaaggtacgtaaagggacggtaaaactacgaaaacgtacgtggtacgcgtagaccactactcgtactctttacc

SEQ ID NO: 372719 - DNA, 505 bp, Homo sapiens
  misc_feature: GZ8MTXP02HVJC0.15.74.G08.1.454.CMB.2.raw
  modified_base (194)..(194): a, c, t, g, unknown or other
  modified_base (245)..(246): a, c, t, g, unknown or other
  modified_base (248)..(248): a, c, t, g, unknown or other
  modified_base (261)..(261): a, c, t, g, unknown or other
  modified_base (270)..(270): a, c, t, g, unknown or other
  modified_base (301)..(301): a, c, t, g, unknown or other
  modified_base (496)..(496): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcacatcacttgccggcagtcagagtatagtacctggtgctgtannancagaacaggaacnccctaatcngatgtataggcatcagcttagaaagtgggtncatacaaggtccagcgcagtgatcgtgggacagattcactctcaccatcacgtcaccctgcagcctagactgtatttgacttaacttattactagtacaactaagtataattagtaacttctaggtacgttcggactaagggaacctaagggtacgtaaataaccaacgtaactggtagaacgtcgactaacctntctctactc

SEQ ID NO: 372720 - DNA, 521 bp, Homo sapiens
  misc_feature: GZ8MTXP02FFTQ9.15.74.G08.1.454.CMB.2.raw
  modified_base (194)..(194): a, c, t, g, unknown or other
  modified_base (316)..(316): a, c, t, g, unknown or other
  modified_base (381)..(381): a, c, t, g, unknown or other
  modified_base (504)..(504): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagatcaccatcacttgccgggcagtcagagtatagtacctggttggctggtatcagcagaaaccagggaaacgcccctaaatcctgatgtataaggcatctagcttaagaaagtggggtnccatcaaggtccagcggcagtggatcgtgggacagaattcactctcaccatcaagccaaccctcncacgcctgatgtatttagtactaacttattactagtactaacaataataaataagtaattactaggtacgttcggaccgaacggaaccgaaggtaggaagtacaaacgaacgtagtggaacgngacacactctactcttc

SEQ ID NO: 372721 - DNA, 544 bp, Homo sapiens
  misc_feature: GZ8MTXP02FKBQA.15.74.G08.1.454.CMB.2.raw
  modified_base (194)..(194): a, c, t, g, unknown or other
  modified_base (270)..(270): a, c, t, g, unknown or other
  modified_base (316)..(316): a, c, t, g, unknown or other
  modified_base (332)..(332): a, c, t, g, unknown or other
  modified_base (414)..(414): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggganatagagtcaccatcacttgccgggcagtcagagtattagtacctggttggctggtatcagcagaaaccagggaaancccctaaactcctgatgtataaggcatctagctagaaagtggggtnccatcaaggtcagcgnagtggatcgtgggacagtaattcactctcaccatcagcacctgcagcctagatgtatttgactaacttatactagtccaaanagtactaaattagtaatttcccgaggtaaccgttcgggaaccctaaaagggggtacccaaaaggggttcggaaaaactcgaaaaacgacgtacggtaggctacgacctaaccattcctaggtcctttccg

SEQ ID NO: 372722 - DNA, 539 bp, Homo sapiens
  misc_feature: GZ8MTXP02F0B6V.15.74.G08.1.454.CMB.2.raw
  modified_base (193)..(193): a, c, t, g, unknown or other
  modified_base (246)..(246): a, c, t, g, unknown or other
  modified_base (322)..(322): a, c, t, g, unknown or other
  modified_base (373)..(373): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccacctgtctgcatctgtggganatagagtcaccatcacttggccggcagtcagatattagtctggtgctggtatnagcagaaaccagggaaacgcccctaaactcctagatgtaataaggcattctagtacttaaggaaaggttgggggtnaccatacgaaggttccagcggacaggtgatcgtggggactagaattcactntcacatcagccacctgcagcctagatgtaatttcgactaaactttagttaactgtacaaactagtaaattataagtaacttcgtggaaccgttcgaccgaaaggaccgaaaaggtcggaaaataacgaaacgtaacgtgtacgaatcgactacatcgtactcttac

SEQ ID NO: 372723 - DNA, 549 bp, Homo sapiens
  misc_feature: GZ8MTXP02G4SVM.15.74.G08.1.454.CMB.2.raw
  modified_base (320)..(320): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagatagagtcaccatcacttgccggcagtcagagtattagtacctggttggcctggtatcagcagaaaccagggaaacgcccctaaaactcctgactgtataaggcatctagcttagaaagtggggtnccatcaagttccagcgcagtggatctggggacagaaattcactctacaccaatcaagcaacctcgcagcctgatagatttatactaacttaattactagtacaactaagtaataaattaagttaacttacgtacgtacgtacgtaccgaacggaacggaaaggtaacggtaaagtaaacgaaaacgaaacgtagtacggtaacgtacgacgactactactactacttac

SEQ ID NO: 372724 - DNA, 553 bp, Homo sapiens
  misc_feature: GZ8MTXP02IMA5G.15.74.G08.1.454.CMB.2.raw
  modified_base (196)..(196): a, c, t, g, unknown or other
  modified_base (266)..(266): a, c, t, g, unknown or other
  modified_base (317)..(317): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctcccttccaccctgtctgcatctggtggganatagagtcaccatcacttgccggcagtcagagtattagtacctggttgctgatcagcagaacaggaaacncccctaatcctagatgtaataggctatcgtagcttaaggaaaggtggggcnccatacgaggttcaggcgcgaggtggatcgtggggacaggaacttccaactctacacatcagcacctgacagcctgattgtatttcgaacttaactttagttactgtactaactagtaataaattagttaacttcgtacggtaacgtccggaaccgtaaacggggacctaaaagggtacgaaaactacgaaaacgtaacgtgtaggctacgactaaccattccgtagtttacctac

SEQ ID NO: 372725 - DNA, 611 bp, Homo sapiens
  misc_feature: GZ8MTXP02FPGK9.15.74.G08.1.454.CMB.2.raw
  modified_base (196)..(196): a, c, t, g, unknown or other
  modified_base (296)..(296): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtcctccttccaccctgtctgcatctggtggganatagagtcaccatcacttggccggcagtcagagtattagtactggttggctggtatcagcaagaaaccagggaaacgacccctaaactcctagatgtaanaaggcatctagacttaaggaaaggtggggtacaccagtacgtaaggtccagcggacaggtgatcgtggggacagtaacttcactcacacatcacgccacctgcagcctagtatgtatttgacttaacttattactagtactaaacgtaattaattaaattacgttaactttccgtacgggtaaccggtttaccgggaaccgtaaaacggggaaccgtaaaagggtaacggtaaaaacgttaccgaaaaacggtaacgttcggtacggaaccgttacggaacctaacccgtagttacctttacgttactttaaccc

SEQ ID NO: 372726 - DNA, 604 bp, Homo sapiens
  misc_feature: GZ8MTXP02JEK3W.15.74.G08.1.454.CMB.2.raw
  modified_base (332)..(332): a, c, t, g, unknown or other
  modified_base (379)..(379): a, c, t, g, unknown or other
  modified_base (429)..(429): a, c, t, g, unknown or other
  modified_base (435)..(435): a, c, t, g, unknown or other
  modified_base (469)..(469): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtaccgtggttggcctggtatcagcaagaaaccagggaaacgacccctaaactcctgactagtataaggcatctagacgtttaagaaaggtggggtacnccattaccgaaaggttcccgaaggccggactaggttcgggattcggnggggtaaccaaggtaacttaccgactcgacaccctatcagcccacccgtnccgacncctagacttgtatttcgactaactttactacgtntacaactagtaataagttaacttattaccggtaggtaccgttacgggaccgtaaaacgggaccgtaaagggagtaaaactacgaaaacgtaaccgtgggtacgaactcggacctactaactcgtcttattacccg

SEQ ID NO: 372727 - DNA, 576 bp, Homo sapiens
  misc_feature: GZ8MTXP02G7IQW.15.74.G08.1.454.CMB.2.raw
  modified_base (195)..(195): a, c, t, g, unknown or other
  modified_base (280)..(280): a, c, t, g, unknown or other
  modified_base (289)..(289): a, c, t, g, unknown or other
  modified_base (302)..(302): a, c, t, g, unknown or other
  modified_base (309)..(309): a, c, t, g, unknown or other
  modified_base (334)..(334): a, c, t, g, unknown or other
  modified_base (383)..(383): a, c, t, g, unknown or other
  modified_base (433)..(433): a, c, t, g, unknown or other
  modified_base (464)..(464): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatcgacccagtctccttccaccctgtctgcatcgtgtgganatagactcaccatcacttcggccggccagtcagtagtattagtacctggttcgcctggtatcgagcaacgaaaccagggaaaccnccctaaacncctagactgtaanagctatntagtacttaagggaacggtggggtnacctagtacgtaagtccaggtccgatacggtggaattccggaggggaanacgtaacttcaaccttcaccactagcacgccacctggcacggtcctaagnttggttatttcaacttaagtttacacttaanaactaagtaataactaattacgttacgtcggtacgtacgtacgaacgaacggtaacgaaggtaacgaaactaacgaacgacgtgcgtaacgcactactagtcctactcctac

SEQ ID NO: 372728 - DNA, 620 bp, Homo sapiens
  misc_feature: GZ8MTXP02JLPSD.15.74.G08.1.454.CMB.2.raw
  modified_base (193)..(193): a, c, t, g, unknown or other
  modified_base (265)..(265): a, c, t, g, unknown or other
  modified_base (319)..(319): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccacctgtctgcatctgtggganatagatcacatcacttgccggccagtcagagtattagtacctggtgctggtatcagcagaaaccaggaaacncccctaaatcctagatagtaataaggcatctagtacttaaggaaaggtgggtcncctatacgtaggttccaggccggactaaggtcggtactcggtcgggggaacctaaggtaacttcccaacgttcctaccaaccctagtaccgaccgaccctaacccgtgacccgacgtccgtaagtacttgtaacgttttcgaccttaaactttagttacctgtaacaaacgtacgttaaataacttaacgttaacgttccgtagggtacgttccgaacggtaaaacgggtaccaaagggttaacgaaacttacgaaaacgtaacgtgtaacggctacgacacgtactctacgttacttacg

SEQ ID NO: 372729 - DNA, 507 bp, Homo sapiens
  misc_feature: GZ8MTXP02JZV83.15.74.G08.1.454.CMB.2.raw
  modified_base (195)..(195): a, c, t, g, unknown or other
  modified_base (255)..(255): a, c, t, g, unknown or other
  modified_base (284)..(284): a, c, t, g, unknown or other
  modified_base (291)..(291): a, c, t, g, unknown or other
  modified_base (370)..(370): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctggtggganatagagtcacatcacgttggccggcagtcagagttattagtaccgtggttcggctggtancagcaagaaccgaggaacacccctaatcngatgtanagcatcagactagaagtggcacatcgaagtcgagcgcaggtgatcgtggggaacagtacttacactctacaccatcacnccaccctgcacgctagtacttgtacttgaacttacttattactgtacaactagtataacgtagtacttcgaggtacgtcggactaacgggacaggtacaaactcaaacgacgtgagctgacacgtatcgtctctacg

SEQ ID NO: 372730 - DNA, 577 bp, Homo sapiens
  misc_feature: GZ8MTXP02F0418.15.74.G08.1.454.CMB.2.raw
  modified_base (195)..(195): a, c, t, g, unknown or other
  modified_base (255)..(255): a, c, t, g, unknown or other
  modified_base (403)..(403): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatcgtgtggganatagatcaccatcacgttgccgggccagtcagagtatagtacgtggttgctggtatcganacgaagaaaccgaggaaacgacccctaaactccgtagatagtaataggacatactagtacgttaaggaaggtggggttacgccatacgtaaggttccgaacgtcggactaaggtcgtagtcgtggggacagtaactcactctcaactnccagtcccactgactacgtccgtagtatcgttaattcgaacttaacttaatcgtatacaaacgtataaatagttataagttcgcggtacgtcgaacgtaaacgggactaaggttaaacggaaataacggtaaaaccgcgttaggacggcttagaccacttatcacttctaaccg

SEQ ID NO: 372731 - DNA, 536 bp, Homo sapiens
  misc_feature: GZ8MTXP02IEPHZ.15.74.G08.1.454.CMB.2.raw
  modified_base (197)..(197): a, c, t, g, unknown or other
  modified_base (278)..(278): a, c, t, g, unknown or other
  modified_base (291)..(291): a, c, t, g, unknown or other
  modified_base (299)..(299): a, c, t, g, unknown or other
  modified_base (323)..(323): a, c, t, g, unknown or other
  modified_base (341)..(341): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtcctgcatcgtggtggganatagagtcaccatcacgttgccgggtcagtcagatattagtaccgtgggttgccttggtatcagcagaaaccagggaaacnccccgtaaatccnggatgtanaggcatctagcttaagaagtgggnccatcaaggtccaggcgnagtgatcgtggggacaggtaacttcactcacaccatcacgcaccgtcgcagcctgattgtatttcacttaacttatactgactaacgataattacgtagtacttacgtggtacgttacgaccgtaaaggaccgaggtaacggtaaactacgaaacgtaacgtgtacggcttcggacactacgtctactcttaccg

SEQ ID NO: 372732 - DNA, 774 bp, Homo sapiens
  misc_feature: GZ8MTXP02IPKF7.15.74.G08.1.454.CMB.2.raw
  modified_base (196)..(196): a, c, t, g, unknown or other
  modified_base (207)..(207): a, c, t, g, unknown or other
tcagtctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctcccttccaccctgtctgcatctggtggganatagagtcacntcacttggccggccagtcagtagttattagtaccttgggttcgccttggtatcagacaacgaaaccgaggggaaaccacccctaaacgtcctagtatacggtaataacggcctaagtcgtaagtacgtttaagggaaaggttggggtcaccagttacgtaaaggtttcccaaggggccggacgtagggttagggtactcggtagggggaacaaggttaacttccaacttcccgtacaacccaactccgaacgtaccctaacccgtcgtacgacgtacccgtaggttacttacgggtttactttaccggtaaactttaactttttaaacttacgtttaacgtaaccctaaagttaaacgtttaaattaaacgtttaacgtttaacgtttaccggtttacggggtaacccggtttaccggggaaacccgggtaaaacggggtaaccccgggttaaaaggggtaaacgggtaaaaacgtaaaccggttaaaaccggttaaccggttaggttaccggtaacgtaccggtaacctaaccggttagtttcctttaccggtttactttaacccg

SEQ ID NO: 372733 - DNA, 539 bp, Homo sapiens
  misc_feature: GZ8MTXP01DM9HH.4.72.G06.1.454.CMB.2.raw
  modified_base (238)..(238): a, c, t, g, unknown or other
  modified_base (341)..(341): a, c, t, g, unknown or other
  modified_base (349)..(349): a, c, t, g, unknown or other
  modified_base (372)..(372): a, c, t, g, unknown or other
  modified_base (414)..(414): a, c, t, g, unknown or other
tcagagcactgtagcacgaccggtgctcgatttagctacgactgcaagggaaaggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccacctctcctgcagggccagtcagagtgttggnactaatttagcctggtaccagcagaaacctggccaagctcccaggctgctcatctataatacaatcacaagggacattggtgtcccagacaggttcagcgganagtggtcnggacagagttcactctacactancagcacgctgtactacttagtaagtattgtctagtactagtntattgtacagagtagtaagtaagttggtcggtccgtcggtcggtcggtacggaacggaacggaacggtaacggtaaacgaacgaaacgaacgtaagtaggtaacgtcgacgactaacgttcgtcg

SEQ ID NO: 372734 - DNA, 522 bp, Homo sapiens
  misc_feature: GZ8MTXP01BW74J.4.72.G06.1.454.CMB.2.raw
tcagagcactgtagcacgaccggtgctcgatttagctacgactgcaagggaaaggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggaccaagctcccaggctgctcatctataatacaatcaacgaagggactagttggtcgtacccagacaggttcagcggcaggtgggtctggggacagagttcactctcactatcagcagcctgctatttgaatatttgctagtctatctattgcagcagtataagttggtgctcgggcgttcggaccaaggggaccaaggtacggaaattacgaaacgttacgtggtcgggcttggccttactaacgttcgtg

SEQ ID NO: 372735 - DNA, 512 bp, Homo sapiens
  misc_feature: GZ8MTXP01ED5MQ.4.72.G06.1.454.CMB.2.raw
  modified_base (322)..(322): a, c, t, g, unknown or other
  modified_base (396)..(396): a, c, t, g, unknown or other
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctccaggctgctcatctataatacaatcacaagggacagttggtntcccagacaggttcagcgcagtgggctgggacagagttcactctcactatcagcagcctgactactttgaagtntttgctagtctatctattgtacagctagttataagttggtcgcctcgggacgttcggaccgaaagggaccgaaaggtaggaaacttcgaaacgactggtgctgcactaacttcgtg

SEQ ID NO: 372736 - DNA, 527 bp, Homo sapiens
  misc_feature: GZ8MTXP01COKF7.4.72.G06.1.454.CMB.2.raw
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccacctctcctgcagggccagtcagagtgttggcactaattagcctggtaccagcagaaacctggccaagctcccaggctgctcatctataatacaatcaacgaagggacagttggtctcccagactacggttcagcggcaggtgggtctgggacagagttcactctcactatcagcagcctgactactttgaagtatttgactagtcttatctattgtcagtctagttataagttggtacggtccgtcggtcggttcggacgaaggggtaccaaagggtacgaattacgaaacgactgtgctggacacctaagttcgttcg

SEQ ID NO: 372737 - DNA, 509 bp, Homo sapiens
  misc_feature: GZ8MTXP01D2OFW.4.72.G06.1.454.CMB.2.raw
  modified_base (502)..(502): a, c, t, g, unknown or other
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctccaggctgctcatctataatacaatcaacaagggactagttggtcgtcccagactaggttcagcggcaggtgggtctggggacaggagttcactctcactatcagcagcctgctactttgaagtatttgctagtctatctattgtcagcagtataagttggtgcctggcgttcggcgaaggggaccaaggtaggaattacgaaacgactgtaggctgcacctnttcttcg

SEQ ID NO: 372738 - DNA, 496 bp, Homo sapiens
  misc_feature: GZ8MTXP01BZPH8.4.72.G06.1.454.CMB.2.raw
  modified_base (362)..(362): a, c, t, g, unknown or other
tcagagcactgtagcacgaccggtgctcgatttagctacgactgcaagggaaaggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagctggtacagcagaacctggccaagctcccaggctgctcatctataatacaatcacaagggacattggtgtcccagacaggttcagcgcagtgggctgggacagagttcactcncactatcagcagcctgctactttgaagtatttgctagtctatctattgtcagcagtataattggtgcctcggcgtcggcgaagggaccgaggtaggaattacgaacgttaactgtgctgtcactaattcgttcg

SEQ ID NO: 372739 - DNA, 589 bp, Homo sapiens
  misc_feature: GZ8MTXP01CAIDZ.4.72.G06.1.454.CMB.2.raw
  modified_base (283)..(283): a, c, t, g, unknown or other
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactcgccaccctctcctgcagggccagtcagagtgtgctataattagctggtacagcagaacctggcaagctccagctgctnatctaataatacaatcaacgaagggactagttggtcgtacccagactacggttcagcggcgaggtgggtcgtggggactaggtacgttcacttcgtacactatcagcagtcctgacctacgtttgaagtatttgactagttacttaggtctaagtttgactagtacgtagttaattaaggttggtacggtccgttacgggacggtttcggggaacttaaacgggggaccaaagggttaacggaaacttacgaaaacggttaccgtttaagggacgggtcttcggaccttaccgtaattcgtttccg

SEQ ID NO: 372740 - DNA, 547 bp, Homo sapiens
  misc_feature: GZ8MTXP01AOFKU.4.72.G06.1.454.CMB.2.raw
  modified_base (252)..(252): a, c, t, g, unknown or other
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccgaggggacactgccaccctctcctgcaggccagtcagagtgtgcatattagctgtacngcagaactgcaagctccagctgctcatctataatacaatcacgaagggactagttggtctacccagactaggttcaggtcggcaggtgggcgtgggacagtacgttcactctctactatcgagcagcctgactactttagaagtatttgactagttctaagttctagttcgtacagtactagttaagttaagttggtacggtcccgttacgggacggttccgacggttaaggggtaaccaaaggggtagaaaacttacgaaaacgttacgtggagtctcgacacctaagttcgtc

SEQ ID NO: 372741 - DNA, 641 bp, Homo sapiens
  misc_feature: GZ8MTXP01EYJZG.4.72.G06.1.454.CMB.2.raw
  modified_base (287)..(287): a, c, t, g, unknown or other
  modified_base (398)..(398): a, c, t, g, unknown or other
  modified_base (432)..(432): a, c, t, g, unknown or other
tcagagcactgtagcacgaccggtgctcgatttagctacgactgcaaggggaaagggggaggaactgctcagttaggacccagacggaaccatggaagccccagcgcagcttctcttcctcctgctactctggctcccagaaagcagtggagaagtagtgatgacgcagtctccagcccaccctgcctgtgtctccgaggggacactgcccaccctctcctgcagggccagtcagagtgtgcatattgctggaccagcagaacctggaccaagcctccaggctgctnatctataatacaatcaacgaagggtactagttggtacgtacccgaagactacggttcaggcggtcgaggtcggggtctggggactaggtacgttcacgttctacacttacncgagcacgtcctagtacttaagtttaggaatttntttcgactagttacttagttcttagttcgtacgtagtacgtaagtttaagttaacggtttcgggtaccggtcccgttacggggtaccggttccgggaaaccggttaaacgggggtaaccgttaaagggtaaacggtaaacgttaaaccggttaaacggttacgttcggggtacgtaaccgttacggacccgttacttaacgtttcgtcg

SEQ ID NO: 372742 - DNA, 552 bp, Homo sapiens
  misc_feature: GZ8MTXP01B118H.4.72.G06.1.454.CMB.2.raw
  modified_base (403)..(403): a, c, t, g, unknown or other
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccgaggggacactgccaccctctcctgcagggccagtcagagtgtgcataattagctggtacagcagaacctggaccaagctccgagctgctcatctataatacaatcacaagggactagttggtctacccagaccaggttcaggcggcaggtgggtctggggacaggtagttcactctcactatcagcagcctgactactttgaaagttnttgactagttactagttctagttgacagtctaagttattaggttcggtcgtccgttacgggtacggttccgggaacgttaaaggggtaccaaagggtaacgtaaacttacgaaacgttacgtggtcgctcgaccttactaagttcgtcg

SEQ ID NO: 372743 - DNA, 626 bp, Homo sapiens
  misc_feature: GZ8MTXP01D12K6.4.72.G06.1.454.CMB.2.raw
tcagagcactgtagcacgaccggtgctcgatttagctacgactgcaagggaaagggggaggaactgctcagttaggacccagacggaaccatggaagccccagcgcagcttctcttcctcctgctactctggctccagaaagcagtggagaagtagtgatgacgcagtctccagcccacctgcctgtgtctcgaggggacactcgccaccctctcctgcgagggccagtcagagtgttgcattaattagctggtaccagcagaacctggaccaagctaccaggctgctacatctaataactacaatcgaagaacggggtactagttggtcgtacccaaggacctagggttacccaaggcgggtaccgaagggttcgggggtacctgggggacctaggttacggtttcaaccgttctcaaactatcgaacgcgacgtctagtacttagttagtattcttcgacttagttctagtcttagttcgacgtagtacgttaaggttagttacggttcggggtccgtccggttacgggtacggtaaccgggaacgttaacggggtaacgttaagggtaaacgtaacttaacggaagttacgtggtggcctacgtacttaccgtgttccgttcg

SEQ ID NO: 372744 - DNA, 692 bp, Homo sapiens
  misc_feature: GZ8MTXP01AS98S.4.72.G06.1.454.CMB.2.raw
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtcgtctccgaggggacactcgccaccctctcctgcaggccagtcagagtgtggcacttattagctggtaccagacaagaactgacaacgcctccgagctgctcactactaataactacaactacgaacgaagggactagttggtacgtaccagtacgtacggttcgaggcggtcgtaggtcgggtaccgggaagacgtaggtcctactaccgtactactactacgtacgacgtacgtacccgttcgtacgtttaaacgtttagtaagttacggtttcacgtacgttacttaaccttgtaacgtttagtccgtaaagtcgttaaacgttagttaacggttacggggttccggtcccgggttacccgggttaacggggtccgggtaaaccggtaaacggggacggtaaacgggttaaacgggtaaaccgtaaccggttaaaacggttcggttacggtcgggccgttaacggacccggttaccttaacttcgggtttaaccttaaccg

SEQ ID NO: 372745 - DNA, 778 bp, Homo sapiens
  misc_feature: GZ8MTXP01AUY7L.4.72.G06.1.454.CMB.2.raw
tcagagcactgtagcacgaccggtgctcgatttagctacgactgcaaggggaaagggggaggaactgctcagttaggacccagacggaaccatggaagcccagcgcagcttctcttcctcctgctactctggctcccagaaagcagtggagaagtagtgatgacgcagtctccagccacctgcctgtgtctccgaggggacactcgccacctctcctgcagggccagtcagtagtagttggcactaagtttagcctaggtacccagcaacgaaacctggacctaacgctcccgaggctgctcaatcctaataaactacgaaattccgaacgaacggggtaactacgtttggtacgttacccccgaaagtaccgtaaccggtttcagggtcccggacgtagggttacgggggttccgttggggaaaccgtgggtaaacgtttccgaacttccggtactaaacgtctacaacgggccttaagggaccccttggttaacccctacgttttaacggtaaacggttaaatttttcgggaaacctttacgtttaactacggtttactaagttcggtacctaaggtacttaaaggtttacttaaggtttcggggtccgttaccgggttccgggttaaccgggttcggtaaaccgggttaaaaccggggttaaccggttaaacggggttaaacggaaaacggttaaaccgttaaaaccggggttaacggtcgggttaccgggtaaccgtaacggtacccgttaacctttaacggttcccgttaacg

SEQ ID NO: 372746 - DNA, 493 bp, Homo sapiens
  misc_feature: GZ8MTXP02JHJAU.4.72.G06.1.454.CMB.2.raw
  modified_base (319)..(319): a, c, t, g, unknown or other
  modified_base (365)..(365): a, c, t, g, unknown or other
tcagagcactgtagcacgaccggtgctcgatttagctacgactgcaagggaaaggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaattagcctggtaccagcagaaacctggccaagctcccaggctgctcatctataatacaatcacaagggacagttgngtcccagacaggttcagcgcagtggtctggggacagagttcactcncactatcagcagcctgctacttgaagtatttgctagtctatcattgtcagcagtataattggtgcctgacgttcggacaagggaccgaaggtacgaaacgtacaaacgactgtgctagcacatctacg

SEQ ID NO: 372747 - DNA, 525 bp, Homo sapiens
  misc_feature: GZ8MTXP02F190Z.4.72.G06.1.454.CMB.2.raw
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcaacaagggacattggtgtcccagacaggttcagcggcaggtgggtctggggacaggagttcactctcactatcagcagcctgctactttgaagtatttgctagtctatctattgtacagctagtataagttggtcgcctcgggacgttcggaccgaaaggggaccaaagggtaggaaaactacgaaacgaactggtacggactacggacaccatctacg

SEQ ID NO: 372748 - DNA, 536 bp, Homo sapiens
  misc_feature: GZ8MTXP02JXA1Z.4.72.G06.1.454.CMB.2.raw
  modified_base (320)..(320): a, c, t, g, unknown or other
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccagggacactgccaccctctcctgcagggccagtcagagtgttggcactaattagcctggtaccagcagaaacctggccaagctcccaggctgctcatctataatacaatcaacaagggacattggntcccagacacggttcagcgcaggtggtctggggacagagttcactctcactatcagcagtcctgctactttgaagtattttcgctagtcttaatctattgtcagctaagtattagttggtacggtcctacgggtacgttaccggaccgaaaggggacccaaagggttaggaaaactacgaaaacggtactaagtcggactcgacaccgtatcttcg

SEQ ID NO: 372749 - DNA, 541 bp, Homo sapiens
  misc_feature: GZ8MTXP02HYLI3.4.72.G06.1.454.CMB.2.raw
  modified_base (416)..(416): a, c, t, g, unknown or other
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccgaggggacactgccaccctctcctgcagggccagtcagagtgttggcactaattagcctggtaccagcagaaacctggccaagctccaggctgctcatctaataatacaatacaacaagggactagttggactacccagactaggttcagcggcaggtgggtctgggggacagtacgttcactctacactatcagcacgtcctgtactactttagaacgttntttgctagtcttatctattgacagtctagtattagtggtcgccgtcggtacgttcggacgaaggggaccaagggtacgaaactacgaaacgtacgtggtacgacgtcgactaccgtattcgtacg

SEQ ID NO: 372750 - DNA, 578 bp, Homo sapiens
  misc_feature: GZ8MTXP02ICPO8.4.72.G06.1.454.CMB.2.raw
  modified_base (265)..(265): a, c, t, g, unknown or other
  modified_base (297)..(297): a, c, t, g, unknown or other
  modified_base (353)..(353): a, c, t, g, unknown or other
  modified_base (411)..(411): a, c, t, g, unknown or other
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcaggccagtcagagtgttggcactaattagctggtaccagcagaacnggaccaagctccaggctgctcatctataatanatcaacaagggactagttggtactcccagtacacggttcaggcgcgaggtgggtcnggggacagtacgttccacttcactactatcagcagcctagctacgtttagaaacgttntttcgactagttacttatactagtttgtacagtctaagttataagtttgggtcgtccgtacgggtaccggtttcggaccggaaacgggtaaccgtaaagggttacgaaaactacgaaaacgtacgtaacggttacgggacttcggacctaccgtagtttccgttacg

SEQ ID NO: 372751 - DNA, 557 bp, Homo sapiens
  misc_feature: GZ8MTXP02IY2BC.4.72.G06.1.454.CMB.2.raw
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaattagcctggtaccagcagaaacctggccaagcctcccaggctgctcatctataatacaatcacaagggctattggtgtcccagactaggttcagcgcaggtggtctgggggacaggtacgttccacctcgtcactatcagcagcctgactactttgaacgttatttgctagtcttatctattgtcagcgtagttattaagttcggtggtaccgtcgggtaccgtttacgggaccgtaaaggggaccgtaaagggttacggaaaactaacgaaaacgaacgtggtaggaccttacgaccaacctgtactttcg

SEQ ID NO: 372752 - DNA, 727 bp, Homo sapiens
  misc_feature: GZ8MTXP02G1R80.4.72.G06.1.454.CMB.2.raw
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccacctgcctgtgtctccgaggggacactgccaccctctcctgcagggccagtcagagtgttggctactaattagcctggtaccagcaagaaacctggccaagcctccaggctgctcatctataatacaatcaacgaagggtactagttcggtacgtaccccgaaggtactacggggttacaggtccgggacgtaacggggttcggggttaccgttaggggggaacctaagggtaacgttttacccgaaacccgtttcgtacctaaaccgttaacttaccgtaaacggtacccaacggtcccccgttaggtaccctttacccgttttaaggtaaacggtttaagtttttcggacccgttaaggttacctttaaacttccgttaagtttcgggtactaacggtacctaaaggtttaactttaaaggttcgggttcggtacccgtacgggtaccggtttaccgggacccgtaaaggggtacccgtaaagggttacgggtaaaactaccggaaacgtaacgtggtacgacgttacgactacctacgttcgttacg

SEQ ID NO: 372753 - DNA, 616 bp, Homo sapiens
  misc_feature: GZ8MTXP02JAIER.4.72.G06.1.454.CMB.2.raw
  modified_base (437)..(437): a, c, t, g, unknown or other
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgtggcactaattagcctggtaccagcaagaaacctggaccaagcctcccaggctgctcatctaataatacaatacaacgaaagggactagttcggtcgtaccccaagtactacggttcaggcggcgtaggtggggtcgtggggactaggtacgttaccgactcctacacttactcagcacgccctgactacgtttagaagttntttgcttagttctattctatttcgacagtacgtaagttaattagttgggtcggtacccgttcggggaaccggtttcgggaaccggtaaaggggtaacccgtaaaggggttaacggaaaacgtaaccgtaaaacggtacgtaaggtacgggtaccttacggacctacctacgtctttacg

SEQ ID NO: 372754 - DNA, 523 bp, Homo sapiens
  misc_feature: GZ8MTXP02FF8MM.4.72.G06.1.454.CMB.2.raw
  modified_base (497)..(497): a, c, t, g, unknown or other
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagcctccaggctgctcatctataatacaatcaacaagggacattggtgtccagacaggttcagcggcagtgggtctgggacagagttcactctcactatcagcagcctgcactttgaagtatttgcagtctatcattgtcagcaagtattaagttggtgcctcggacgttcggaccgaagggaacctaagggtaggaaaacgtaccgaaaagtaaccgtggnggtacgtcgacgtaccacgtcttacg

SEQ ID NO: 372755 - DNA, 515 bp, Homo sapiens
  misc_feature: GZ8MTXP02JYYXW.4.72.G06.1.454.CMB.2.raw
  modified_base (320)..(320): a, c, t, g, unknown or other
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaattagcctggtaccagcagaaacctggccaagctcccaggctgctcatctataatacaatcacaagggacattggngtcccagacaggttcagcgcagtgggtctggggacagagttcactctcactatcagcagcctgcactttgaagtattttgctagtctatcattgtcagcagtataatggtgcctcggacgttcggacctaagggacctaagggtacggaaaacgtacgaaaacggaactggtagggactaggcacctagtcttcg

SEQ ID NO: 372756 - DNA, 629 bp, Homo sapiens
  misc_feature: GZ8MTXP02FJMCD.4.72.G06.1.454.CMB.2.raw
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaattagcctggtaccagcaagaaacctggaccaagcctcccgaggctgctcatctaataatacaatacaacgaaagggactagtttggtcgtacccaaggtacctagggttcaggcggctaggtgggtctgggggacaggtacgttcactctacactatacagcacgcctgactacgtttagaagttatttgactagttctatctattcgtactagactagttaacttaagtttcgggtcggtaccgttacggggtaccggtttaccgggaccggtaaacgggggtaaacccgtaaaggggttaaacggtaaaacgttaaccggaaaaccggtaaaccgttgggttacgggtaccgtacggtaccctaaccgtacgttcgtttacg

SEQ ID NO: 372757 - DNA, 656 bp, Homo sapiens
  misc_feature: GZ8MTXP02FFP7M.4.72.G06.1.454.CMB.2.raw
  modified_base (455)..(455): a, c, t, g, unknown or other
tcagagcactgtagcacgaccggtgctcgatttagctacgactgcaaggggaaaggggggaggaactgctcagttaggacccagacggaaccatggaagccccagcgcagcttctcttcctcctgctactctggctcccagaaagcagtggagaagtagtgatgacgcagtctccagccaccctgcctgtgtctccgagggacactcgccaccctctcctgcagggccagtcagagtgttggctactaattgctggtaccagcaagaaacctggaccaagcctcccgaggctgcctcatctaataatacaatcaacgaagggactagtttcggtcgtacccagtacgtacggttcacggcggacgtagggtcggggtcgtggggaacaggtacgtttaccactctaccacttatcaggccaacggtccctagtacctacgtttagtaaacgtttntttacgacttagttctaatcttagttgtacgagtacgttaagttaagttaacggtttcgggtacggtacccgttacggggtaaccggttaccgggaaaccgggtaaacggggtaaaccggtaaaggggtaaacggaaaacgtaaaccgaaaacggtaacgtaaggtacggtacgtacgtaccgtaacgtacgtacgttacg

SEQ ID NO: 372758 - DNA, 690 bp, Homo sapiens
  misc_feature: GZ8MTXP02IDF5L.4.72.G06.1.454.CMB.2.raw
  modified_base (231)..(231): a, c, t, g, unknown or other
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagcccacctgcctgtgtctccgagggacactcgccacctctcctgcaggccagtcagngttgtggactacttaattcgctggtaccagcaacgaaacctcggaccaagcctcccgaggtctcgctcattctaataataccaatacaacgaagggactagttcggtcgtaccccaaggtacgtacggttaccgaaggtcggacgtaagggttcggggtacctgggggaacctaggtacgtttaccaacgtctacactactcaggcacgtcctagtacttaacggtttagaaacgttagttttacgacctagtttaccttaaagtttccttaagttttaccgtacgaacgttacgtaaagttttaaatttaacgggtttcgggttacggtacccggtttacggggtaaccggtttaccggggaaccgtaaacgggggaaaccttaaagggggtaaacggtaaaactaaccgtaaacggtaacgtgggttacgacgtacgacgtacctaacgttcttacg

SEQ ID NO: 372759 - DNA, 667 bp, Homo sapiens
  misc_feature: GZ8MTXP02IKTKL.4.72.G06.1.454.CMB.2.raw
  modified_base (289)..(289): a, c, t, g, unknown or other
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctcagccaccctgcctgtgtctccaggggacactgcccacctctcctgcaggccagtcagagtgttggcactaattagcctggtaccagcagaaacctggacaagctacccgagctgtcncatactaataaactacaatacaacgaaggactagttggtcgtaccaagtacgtacgtacgagcggacgtaagggttcgggtacgtacggggtacaaggtaccgtttaccaccgttccgtacaacgttaactcgaacgtacgaacgtcctagaccttacgtttaaggaactttagtttagacgttagttaccttattacgttagttcgtactacgattaagttaacttaaggttcggtcggtaccgttaacggggtcgtttaaccggggaccgtaaaacgggggtacccgtaaaagggtaacggtaaaccgtaaaacgttaaccgtaaacgttaacggtaccggaacgttcggaaacttcccgtaaacgttcgtttacg

SEQ ID NO: 372760 - DNA, 678 bp, Homo sapiens
  misc_feature: GZ8MTXP02FOPR8.4.72.G06.1.454.CMB.2.raw
tcagagcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccgaggggacactcgccaccctctcctgcgagggccagtcgagtagtgttggctaacttaattacgccttaggtaccagacaagaaacctgggaccaacgcctacccgaggctgcctcgattactataactacaatcaagaaggacatttggtcgtaccaagactacggttacacggcggcgtaggtcgggttacgtggggactaggtacgtttaccgaccttacgtactactattaccgaagcctagcccgttgtacgtaccgttttaagaaacgtttgttttacgacttagttctagttactagtttcgactaaggtactaagttaagtaagttcgggaccggtcgttacggggtacgtttcccgggaaacgtaacggggaaaaccggttaagggtaaacggtaaaaaccgtaaacggaaaacccgttaaaggtcgggttaggaacccgttacggaaccctaaccgtacgttaccgttttaccg

SEQ ID NO: 372761 - DNA, 667 bp, Homo sapiens
  misc_feature: GZ8MTXP02FHB83.4.72.G06.1.454.CMB.2.raw
  modified_base (289)..(289): a, c, t, g, unknown or other
tcagagcactgtagcacgaccggtgctcgatttagctacgactgcaagggaaagggggaggaactgctcagttaggacccagacggaaccatggaagcccccagcgcagcttctcttcctcctgctactctggctcccagaaagcagtggagaagtagtgatgacgcagtctccagccaccctgcctgtgtctccgagggacactgccaccctctcctgcaggccagtcagagtgttgctatattagcctggtaccagcagaaacctggccaagcctccaggtctgctnatccaatactacaatcaacaagggtacagttacggtcgtaccaaggtactacggtttcaaggcggctaacggggttgggtcgtgggggactaggggtacttaccaacttcgtacctacttacgttaccgagacccgtaacgtaccgttgtaccctaaggttttaacgtaaaggtttatttttaacggcgtaaacgtttccgtaaattccggtattttacgacgaggtaccctaaaggttactaaacggttttgggaccggtccgttacgggaaccggtttccggtacccggaaacggggttaaacccggaaaggttacggtaaaaactccgaaaaacgtaccgtaaggtacgacgtacgaccaactacttcgttaccg

SEQ ID NO: 372762 - DNA, 538 bp, Homo sapiens
  misc_feature: GZ8MTXP01D7DPU.44.74.G08.1.454.CMB.2.raw
  modified_base (284)..(284): a, c, t, g, unknown or other
  modified_base (294)..(294): a, c, t, g, unknown or other
  modified_base (310)..(310): a, c, t, g, unknown or other
  modified_base (324)..(324): a, c, t, g, unknown or other
tcagacagtatatacacgaccggtgctcgatttagtagctctatcaggggagagctgctcagttaggacccagagggaaccatggaaacccagcgcagcttctcttcctcctgctactctggctcccagataacaccggagaaattgtgttgacgcagtctccaggcaccctgtctttgtctccgaggggaaagagccaccctctcctgcagggccagtcagagtgttgaccaaaaatcttagtctggttccagcagaaacctggccagactcccaggctcctnatctatggtncatccagcagggcctntggcactcccgganaggttcagtggcagtgggtctggggacagaacttcaactctcaccatcagcagactggagcctgaagtatttgctagtgtattactgtcagctagtatgcttactctacctctacgacgttcggaccgtaagggaccaaagggtggaaatacgaaaacgtaacgtgttcggcttcggaaccacgtaatcgtgttccttcgttaacgtttccccg

SEQ ID NO: 372763 - DNA, 534 bp, Homo sapiens
  misc_feature: GZ8MTXP01EL1CC.44.74.G08.1.454.CMB.2.raw
  modified_base (271)..(271): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttanaccatcaactgggtgcgccaggcccctggacaaggcttgagtggatgggtggaatcatccctcttttgctccactcacctacgcaacgagcttccggggcagaattacgattaccgcggacaagtccacagacacagtctaccatgacaatgagttctttagaaatccgacgacacggcctctactactgtgcgagcgtcccgttaccccagctcgcagttggacgtcctttgaacgtatcgttgggggcaaggggtaacccg

SEQ ID NO: 372764 - DNA, 545 bp, Homo sapiens
  misc_feature: GZ8MTXP01BZLQE.44.74.G08.1.454.CMB.2.raw
  modified_base (270)..(270): a, c, t, g, unknown or other
  modified_base (331)..(331): a, c, t, g, unknown or other
  modified_base (396)..(396): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaatactaccagttccactacttanaccatcaactgggtgcgccaggcccctggacaaggcttgagtgagtgggtgatcatccctnttttggctcactcacctcgcaacgagcttcggggcagtaattacgattaccgcggacaagtccanagacacagtctccatgacaatgtagtttcgttagaaactccgaacgacaccggccgtactactactgtacgcgagaacggtcccgttacccagctacgcagttcggacgtcctttgaagtgtcggttagggggccaaggggtaaccccg

SEQ ID NO: 372765 - DNA, 538 bp, Homo sapiens
  misc_feature: GZ8MTXP01ARZZU.44.74.G08.1.454.CMB.2.raw
  modified_base (273)..(273): a, c, t, g, unknown or other
  modified_base (481)..(481): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggccctctggaagtactaccagttccactacttanaccatcaactggtgcgccacggcccctggacaaggcttgagtggatgggtgaatcatccctcttttggctccactcacctacgcaacgagcttccggggcagaattacgattaccgcgacagtccacagacacagtctcatgacaatgagttctttagaaatccgacgacacggccgtctactactgtgcgagcggtcccgttacccngcctcgcagttcggatcccgtttgaagagtccggttgggggcgttaagggaaccccg

SEQ ID NO: 372766 - DNA, 547 bp, Homo sapiens
  misc_feature: GZ8MTXP01EQAEB.44.74.G08.1.454.CMB.2.raw
  modified_base (382)..(382): a, c, t, g, unknown or other
  modified_base (390)..(390): a, c, t, g, unknown or other
  modified_base (422)..(422): a, c, t, g, unknown or other
  modified_base (439)..(439): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccgaggggaaagagccaccctctcctgcagggccagtcagagtgttgaccaaaaactcttagtctggttccagcagaactggcagactccagctctcatctatggtgcatccagcagggcctctggcacgtcccggacaggttcaggtggcaggtgggtctggggacagaaccttcaactctaccatcagcagactganctgaagtntttgctagttgtattactgtcagtctagggtnttgtcttactcaccttntcggtaccgttcggcgaaacgggaccaagggtaaggaaattacgaaacgttacgtggtcggcttcgactaacctattcgttgtccttactaacttcccgttaaccccg

SEQ ID NO: 372767 - DNA, 528 bp, Homo sapiens
  misc_feature: GZ8MTXP01EBOA3.44.74.G08.1.454.CMB.2.raw
  modified_base (269)..(269): a, c, t, g, unknown or other
  modified_base (284)..(284): a, c, t, g, unknown or other
  modified_base (329)..(329): a, c, t, g, unknown or other
  modified_base (501)..(501): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaatactaccagttccactacttanaccatcaactgggtncgccaggcccctggacaaggcttgagtggatggtgaatcatcctnttttggctccactcacctacgcaacgagcgttccggggcagaattacgattaccgcgacaagtccacagacacagtctccatgacaatgagttctttagaaactccgacgacacggccgtactactactgtgcgagaacggtccgacccagctcgcagttggagtcctttgngatcggttcgggggcaacgggtaaccg

SEQ ID NO: 372768 - DNA, 541 bp, Homo sapiens
  misc_feature: GZ8MTXP01D35R4.44.74.G08.1.454.CMB.2.raw
  modified_base (271)..(271): a, c, t, g, unknown or other
  modified_base (333)..(333): a, c, t, g, unknown or other
  modified_base (399)..(399): a, c, t, g, unknown or other
  modified_base (513)..(513): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctctggaagtactaccagttccactacttanaccatcaactgggtgcgccaggcccctggacaaggcttgagtggatgggtgaatcatccttnttttgctccactcacctacgcaacgagccgttcggggcagaattacgattaccgcgacaagtccanagacacagtctcatgaacaatgagtttctttagaaactccgacgacaccggcctctactactgtgcgagcgtcccgttacccagcgtcgcacgttggacgtccgtttgaacgtntcggttgggggtaacgcggggtaacccg

SEQ ID NO: 372769 - DNA, 528 bp, Homo sapiens
  misc_feature: GZ8MTXP01C0TPW.44.74.G08.1.454.CMB.2.raw
  modified_base (232)..(232): a, c, t, g, unknown or other
  modified_base (270)..(270): a, c, t, g, unknown or other
  modified_base (506)..(507): a, c, t, g, unknown or other
  modified_base (518)..(518): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcngcacggcctctggaagtactaccagttccactacttanaccatcaactgggtgcgccaggcccctggacaaggcttgagtggatgggtggaatcatccctctttttggctccactcacctacgcaacgagaacttccggggcagaattacgattaccgcggacaagtccacagacacagtctccatgacaatcgagttctttgaaattccgacgacacggccgtctaactactgtgcgagaaggtccgttacccagctcgcagttgagccttgnntcgttggggcngggtaacccg

SEQ ID NO: 372770 - DNA, 541 bp, Homo sapiens
  misc_feature: GZ8MTXP01EU7V2.44.74.G08.1.454.CMB.2.raw
  modified_base (270)..(270): a, c, t, g, unknown or other
  modified_base (371)..(371): a, c, t, g, unknown or other
  modified_base (399)..(399): a, c, t, g, unknown or other
  modified_base (482)..(482): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccagttccactacttanaccatcaactgggtgcgccaggcccctggacaaggcttgagtggatgggtgaatcatccctcttttggctccactcacctacgcaacgagcgttccggggnagattacgattaccgcggacaagtccanagacacagtctccatgacaatgagttcttgaaatccgacgacacggccgtctactactgtcgcgagaacggtcccgttacccngctcgcagttggacgtcctttggaagtatccggttagggggtccaacgggggtaacccg

SEQ ID NO: 372771 - DNA, 585 bp, Homo sapiens
  misc_feature: GZ8MTXP01A856F.44.74.G08.1.454.CMB.2.raw
  modified_base (245)..(245): a, c, t, g, unknown or other
  modified_base (274)..(274): a, c, t, g, unknown or other
  modified_base (423)..(423): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttctgcacggcctntggaacgtactaccagttccactacttanaccatcaacgtggtgcgccgacggcccctggacgaagggcttggaggtggagtggggtggaatctacttcccttcttttggctccactcacctacgcaacgacgtcgttccggggacaagtacttacgacttaccgcgacaacgtccanacgacacacgtctacatcgacaatgtattcgttagaaactccgacgaccaccggtcctctactctggtgcgagaacggtcccgacccgacgccgtcgcttagttcgggaactccgtttaggaacgtacggtcggttacgggggccgttaacggggtaacccg

SEQ ID NO: 372772 - DNA, 571 bp, Homo sapiens
  misc_feature: GZ8MTXP01A5UWV.44.74.G08.1.454.CMB.2.raw
  modified_base (194)..(194): a, c, t, g, unknown or other
  modified_base (292)..(292): a, c, t, g, unknown or other
  modified_base (309)..(309): a, c, t, g, unknown or other
  modified_base (365)..(365): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccaggggaaanagccaccctctcctgcagggccagtcagagtgttgacctaaaaactcttagtctggttccagcagaactggccagactccaggctctcatctatggtncatcccagcagggcctntggcacgtcccggataggttcaggtggctaggtggggtctggggacaggaccttcnctctcaccatccagcagacgtggacgctagaagtagttttgactagtagtattactgttacagcgaaggttattgtacctttaactcctaccgttccgtacgtaccggtttccggaaccgaaacgggaccgaaagggtacggaaactacgaaacgtaaacgtggttacggcttacgaacaccaatctcgttctaacttcgttcccg

SEQ ID NO: 372773 - DNA, 564 bp, Homo sapiens
  misc_feature: GZ8MTXP01BFGSY.44.74.G08.1.454.CMB.2.raw
  modified_base (270)..(270): a, c, t, g, unknown or other
  modified_base (333)..(333): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccagttccactacttanaccatcaactgggtgcgccaggcccctggacaaggcttgagtggagtgggtgaatcattcctntttggctccactcacctacgcaacgagcgttccggggacagaattacgacttaccgcggacaagtccaacacgacacacgtctccatgacaatgtagtttctttagaaacttccgaacgaccaccggtccgtactacctacgtgtcgcgagaacggtcccgttacccagcgtcgcttagttcggacgtcctttgaacgtacgtcggttcgggggcttaacggggtaacccg

SEQ ID NO: 372774 - DNA, 582 bp, Homo sapiens
  misc_feature: GZ8MTXP01CJRQY.44.74.G08.1.454.CMB.2.raw
  modified_base (136)..(136): a, c, t, g, unknown or other
  modified_base (233)..(233): a, c, t, g, unknown or other
  modified_base (270)..(270): a, c, t, g, unknown or other
  modified_base (285)..(285): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctntttgtggtggcagcagcaacaggtgtccagtccctggtgcaactggtgcagtctgggactagaatgccgcaaccttggtcctcggtgaccctttccngcacggcctctggaatactaccagttccactacttanaccatcaactgggtncgccaggcccctggacgaaggcttgagtggatggatggaatcatccttcttttggccctcactcacctacgacacgaagaccgttccggggacaacgtaaattaccggacttaacccggacggaacaaacggtccaacgaacgacactacgtctaccatcgaactaatgtacgtttactttagaaactccgaacgacaccgggtcctactactactgtcgcgaagacgttccgtacccagcctcgcgttattgggaactccgtttggacgtacgttcggtcgggggcgtaaccgggg

SEQ ID NO: 372775 - DNA, 539 bp, Homo sapiens
  misc_feature: GZ8MTXP01A3OHW.44.74.G08.1.454.CMB.2.raw
  modified_base (271)..(271): a, c, t, g, unknown or other
  modified_base (334)..(334): a, c, t, g, unknown or other
  modified_base (513)..(513): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttanaccatcaactgggtgcgccaggcccctggacaagggcttgagtggatgggtgaatcatccctnttttggctccactcacctacgcaacgagcgttccggggcagaattacgattaccgcggacaagtccacagacacagtctccatgacaatgagttctttagaaatccgacgacacggccgtctactactgtgcgagaacggtccgttacccagcctcgcagttggacgtcctttgaagtntcggttgggggcaaggggtaaccccg

SEQ ID NO: 372776 - DNA, 548 bp, Homo sapiens
  misc_feature: GZ8MTXP01EDKVA.44.74.G08.1.454.CMB.2.raw
  modified_base (269)..(269): a, c, t, g, unknown or other
  modified_base (284)..(284): a, c, t, g, unknown or other
  modified_base (334)..(334): a, c, t, g, unknown or other
  modified_base (519)..(519): a, c, t, g, unknown or other
  modified_base (528)..(528): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaatactaccagttccactacttanaccatcaactgggtncgccaggcccctggacaaggcttgagtggagtgggtgaatcattcccttnttttgctccactcacctacgcaacgagccgttccggggcaagattacgattaccgcggacaagtccaacagacacagtctaccatgacaatgtagtttcgtttagaaactccgacgacgaccggccgttactactactgtgcgagaacggtcccgacccagctcgcagttcgggactccgttagngtagtcggnggggtcgaacgggtaacccg

SEQ ID NO: 372777 - DNA, 548 bp, Homo sapiens
  misc_feature: GZ8MTXP01ATECC.44.74.G08.1.454.CMB.2.raw
  modified_base (271)..(271): a, c, t, g, unknown or other
  modified_base (286)..(286): a, c, t, g, unknown or other
  modified_base (334)..(334): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaatactaccagttccactacttanaccatcaactgggtncgccaggcccctggacaagggctgagtggatgggtgaatcatcccttnttttggctccactcacctacgcaacgagcttcggggcagaatacgacttacgcgacaagtccaacagacacagtctccatgacaatgagtttcttagaaacttccgacgacaccggccgtactactactggtgacgaggaacggtcccgttaccccgagcctcgacagttcggacgtccttgcgtagtcggttgggggtcgaacgggtaacccg

SEQ ID NO: 372778 - DNA, 613 bp, Homo sapiens
  misc_feature: GZ8MTXP01CREZ6.44.74.G08.1.454.CMB.2.raw
  modified_base (270)..(270): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctctggaatactaccagttccactacttanaccatcaactggtgcgccaggcccctggacaaggcttgagtggagtgggtagatcatcctcttttgctccactcactacgcaacgagcgttcgggcaagaatacgactaccgcgacagtccaacagacacagtcctacagtacgaacagtagtacgtttacgttaacgtaaacgtcccgaacgaccgacccggtcccttacttaacctacgtggtacggtacggacggtaaccggttaccccgttaccccgacgccgtaccgacgttacggttgggaaccgtttccgttaggaacgtacggttaccggggttacgggggaaccggttaaccgggttaacccgg

SEQ ID NO: 372779 - DNA, 781 bp, Homo sapiens
  misc_feature: GZ8MTXP01DW9UB.44.74.G08.1.454.CMB.2.raw
  modified_base (136)..(136): a, c, t, g, unknown or other
  modified_base (272)..(272): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctntttgtggtggcagcagcaacaggtgtccagtccctggtgcaacgtggtgcagtctgggactagaatgccgcaacttggtcctcgtcgaccctttcctgcacggcctctggaagtacctaccagttccactacttanaccatcaacgtgggtcgcgccacggcccctaggacgaacgggctttaggaggtggagttgggggtaggtaaatctacttccccctttcgttttttggccttacctaccttccaacccgtaccgaccgaaaccgggtaacgtccggtttaccccggggggactaaacggtaaaacgtttaacccgggtaacgtttaaaccccgggacgggtaaaccaaaccggttacccaaaccgaacggaaacccaaactaacggttacccttaccgaatacggaaacctaaagttaggttaacggttttacgttttaaacgtaaaacgttaccccggaacgtaacccgaaccgggtcccgttaaccttaaccttaccgtgttacggaccgaacgggtaaccgggttacccccgttaaccccgaggcccttccggacttaccggttggaaccggttcccgttttaagggccggtaagtcggggttacggggggtaacccgaacggggggtttaaccccg

SEQ ID NO: 372780 - DNA, 729 bp, Homo sapiens
  misc_feature: GZ8MTXP01BZ6IC.44.74.G08.1.454.CMB.2.raw
  modified_base (276)..(276): a, c, t, g, unknown or other
  modified_base (655)..(655): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagaatgccgcaacgttggtcctcggtcgtaccctttctgcacggcctcgtaggaagttactacacgttccactacttanaccaatctaaacgtgggtgccgccgacggccccgtaggacgaagggtcttggaggtggagttgggggtaggaactcgtaacttccccgtttcgttttttcggccttaccctacctacgtaacccgtacgcctaaagttacggaacgtaccggtttaccgggggactaaacggtaaacttaacggtaacttaacccgggaccggaaacctaaacggtcccaaacgaacgaacgaacctacgtacctaccaagttacgaaactaaagttacgttaacgggtttacgttttaacgaaaacgttcccggaaacgacgtacccgggtacgttaccgtacttaacgtgtacggccgtaacggtaaccggttcccggtaaaccccncgtccgtcgacgttacggttcggtaaccgttccgttaaggacgtcggttaccggggtcggggaaccgtaacggg

SEQ ID NO: 372781 - DNA, 559 bp, Homo sapiens
  misc_feature: GZ8MTXP01BKH3Z.44.74.G08.1.454.CMB.2.raw
  modified_base (269)..(269): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactacagttccactacttanaccatcaactgggtgcgccaggcccctggacaaggcttgagtggagtgggtggaatcatcccttcttttggctccactcacctacgccaacgagcgttccggggacagaacttacgattaccgcggacaacgtccaacagaacacagtctacatgacaatgagttctttagaaactccgaacgacgacggcccgtactaaccgtactggtgccgaggaacggtcccgacccagcgtcgcagttcggagtcctttggaacgcgtcggttcgggggaacgcggggtaacccg

SEQ ID NO: 372782 - DNA, 627 bp, Homo sapiens
  misc_feature: GZ8MTXP01B8NOF.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtcgtgggactagaatgccgctaaccttggtcctcggtcgtaccctttctgcacggcctctggaactactacctagttccactacttacaccatcaacgtgggtgccgccgacggcccctggacgaagggtcttggaggtggagtggggtaggaatcacttccctttcgttttcggctccactcacctacgcaacgacgtcgttccggggacaagtaacgttacgacgttaccggacggacgaacgtaccacacgacacacgtacctaccactacgacaatagtagtttacgtttacgtaaacgtaccgacgaccgaccggtccgtactactactggggggggggggggggtctcggaggaacggtacccgttacccgacgcgtcgcgacgttcggacgtcgttgtaagtacgtcggttcggggtcggaacgggtaaccg

SEQ ID NO: 372783 - DNA, 548 bp, Homo sapiens
  misc_feature: GZ8MTXP01BJ3BY.44.74.G08.1.454.CMB.2.raw
  modified_base (231)..(231): a, c, t, g, unknown or other
  modified_base (269)..(269): a, c, t, g, unknown or other
  modified_base (333)..(333): a, c, t, g, unknown or other
  modified_base (369)..(369): a, c, t, g, unknown or other
  modified_base (492)..(492): a, c, t, g, unknown or other
tcagacagtatatacacgaccggtgctcgatttagtagctctatcagggggagcatcacataacaaccacattcctcctctaaagaagcccctgggagcacagctcatcaccactggactggacctggaggttcctctttgtggtggcagcagcaacaggtgtccagtccctggtgcaactggtgcagtctgggactagatgccgcaccttggtcctcggtgaccctttcngcacggcctctggaactactaccagttccactacttanaccatcaactggtgcgccacggcccctggacaaggcttgagtggagtgggtgaatcatcccttnttttgctccactcactcgcaacgagcgttccggggnagaattacgattaccgacgacaagtccacacgacacagtctccatgacaatgtagtttcgtttagaaactccgaacgtacgaccggtccgtactactactgtacgcgagcggtccgttacccngcgtcgcagttcggacgtccttagaagtgtcggttacggggtcgaacgggtaaccg

SEQ ID NO: 372784 - DNA, 734 bp, Homo sapiens
  misc_feature: GZ8MTXP01C7QGU.44.74.G08.1.454.CMB.2.raw
  modified_base (236)..(236): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagttccctggtgcaacgtggtgcagtctgggactagaatgccgctaaccttggtcctcggtctaccctttcngcacggcctgtaggaactactaccacgttccactacttacaccatcaacgtggtcgccgccgacggccccctaggacgaaggtcttggaggtggagtgggggtagaatcgtacttccttcgtttttggcttccacctcaccgtacgcaaacgacgtccgttccggggactaacggtaaatttaaccgaacgttacccggacgggaaacctaaacggtacccaaacgaacggaaccaacgtaacgttacccttacccaaagtacgaaacctaaagttcgttaacggttttaccttttaaggaaaaaccttccccgggaaaccgtaaccgaacccgggtccccgttaacttaacccgttaaccgtggtacggaccggtaacgggtaacccgggttaccccgttaccccgaaggttcccttacgggacttaaggttcgggacgttccgtttagggaacgtacggtccgggttgggggaaccgttaacgggggttaaccccg

SEQ ID NO: 372785 - DNA, 550 bp, Homo sapiens
  misc_feature: GZ8MTXP01DLYZA.44.74.G08.1.454.CMB.2.raw
  modified_base (270)..(270): a, c, t, g, unknown or other
  modified_base (363)..(363): a, c, t, g, unknown or other
  modified_base (396)..(396): a, c, t, g, unknown or other
  modified_base (528)..(528): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctctggaatactaccagttccactacttanaccatcaaactggtgcgccaggcccctggacaaggcttgagtggatgggtggaatcgattccctcttttggctccactcacctacgcaacgancgttcgggcagaatacgattacgcgacagtcanagacacagtctccatgacaatgagttactttgaaacgttccgaacgaccacggccgtactacctactgtcgcgaggaacggtcccgttaacccaggcttcgcacgttcggactcccgtttgaacgtatcggngggggtcgaacgggtaaccccg

SEQ ID NO: 372786 - DNA, 575 bp, Homo sapiens
  misc_feature: GZ8MTXP01CANJH.44.74.G08.1.454.CMB.2.raw
  modified_base (426)..(426): a, c, t, g, unknown or other
  modified_base (478)..(478): a, c, t, g, unknown or other
  modified_base (483)..(483): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccccggtgcaactggtgcagtctggacgtagaatgccgcaaccttggtcctcggtgtacccttcctgcacggcctctggaagtactaccagttccactacttataccatcaactgggtgcgccacggcccctggacaagggcttgagtggatgggtggaatcacttcccttctttttggctctaccctcactacgcacgaacgacgttccggggcaagaattacgattaccgcggacaacgtcacagacacagtctcangacgaatgatttcttaggaaactccgacacgaacgccgtctactactgtcgngacgnggtaacccctcccagcttcggtaccagttcgggagttcccgttttggagaacgttcggtcggggggaccgaacgggggttaaccccttgggg

SEQ ID NO: 372787 - DNA, 763 bp, Homo sapiens
  misc_feature: GZ8MTXP01D71H7.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgcaacctttggtcctcggtcgtacccctttcctgcaccggtcctcgtaggaacgtactaccagttccactaacttactaccatacaaacgtgggtgccgccgacggccccctgggaaccgaagggcttggaggttggagtgggggtaggaaatctacttcccctttgtttttcggcctttacccaccttaccaacccgttaaccgccaaaccgggtaacgtaaccggtttcccgggggacctaaagggtaaactttaaccggtaacgtttaacccgggaccgggtaaaccaaaggttaccccaaacgaacgaaccaacgtaacgttcctaaccaagtacgaacgtaaagttacgttaacgtttacgtttaacgtaaacgtaaccgtaaccgaaccgtaacccggtaccgttaccgttaaccttacgtcgtacggtacggaacggtaaccggtacccgttaccccgtaccgttaccgtaccgacgttacgttcggttacgttaaccgtttagtaacgtacgtacgggttacgggggtaaccgggaaccgggtaacccgg

SEQ ID NO: 372788 - DNA, 689 bp, Homo sapiens
  misc_feature: GZ8MTXP01CFXSU.44.74.G08.1.454.CMB.2.raw
  modified_base (241)..(241): a, c, t, g, unknown or other
  modified_base (283)..(283): a, c, t, g, unknown or other
tcagacagtatatacacgaccggtgctcgatttagtagctctatcagggggagcatcacataacaaccacattcctcctctaaaagaagcccctgggagcacagctcatcaccatggactggacctggaggttcctctttgtggtggcagcagcaacaggtgtccagtccctggtgcaactggtgcagtctgggactagaatgccgacaaccgtttggtcctcggtcgtaccccttttccngccacggcctctagggaactactacctagttccactacttanaccatcaacgtggtcgccgccgacggccccgtggacgaacgggtcttaggacggtggagttgggtggtaatctacttcccttcgttttgctcccactcaccctacgaccaacgacgtaaccgttccggggactaaggtaaacgttaccgtaacgttacccggacggtaaccgtaacgtacccgaacgacgtaacaccgaacggttcctaccagtacgaacgtaaagttcgtaacgtttccgtttaagaaaacgttccgaaaccgaccgaaccggtccgtacttacgtacgtgttcgacggacgtaaccgggttacccgttcccgaacggttccgtaccggcacggttcgggacgtccgtttaggcggtacgttcgggttcgggggaaccgaacggggtaaccccgg

SEQ ID NO: 372789 - DNA, 554 bp, Homo sapiens
  misc_feature: GZ8MTXP01B1W1U.44.74.G08.1.454.CMB.2.raw
  modified_base (233)..(233): a, c, t, g, unknown or other
  modified_base (272)..(272): a, c, t, g, unknown or other
  modified_base (340)..(340): a, c, t, g, unknown or other
  modified_base (409)..(409): a, c, t, g, unknown or other
  modified_base (453)..(453): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcngcacggcctctggaacgtactaccagttccactacttanacatcaacgtggtgcgccacggcccctggacaaggcttggagttggagtgggtggaatcattcccttnttttggctccactcacctcgcaacgagccgttccggggcagaacttacgattaccgcggacaagtccanagacacagtctccatgacaatgagtttcttagaatccgacgacnccgtccgtctaactctggtgcgaggaacggtcccgttacccagccgtcgcagttcggacgtccgtttgaagtacgtcggttcgggggcaacgggtaacccg

SEQ ID NO: 372790 - DNA, 654 bp, Homo sapiens
  misc_feature: GZ8MTXP01CS3S8.44.74.G08.1.454.CMB.2.raw
  modified_base (247)..(247): a, c, t, g, unknown or other
  modified_base (276)..(276): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgacaaccttggtcctcggtgacccctttcctgcacggtccctntaggaagtactaccagttccactacttanaccatcaactgggtgcgccacggcccctggacgaagggcttggaggtaggagtgggtaggaatcgacttcccttcgttttgctcctacctacacctacgcgaaacgacgtccgttcggggactaagaacttacgacttaccggacgacaacgtaccaacgagaaccacgtacgtcctaccgaagtacgaactaagtacgttaacgtttcggttttaaacgaaaccgttacccggaaccgtaaccggaccggtcccgttacttaaaccgtacgtcggtcgacggtaacgtccgggtccccttacccgacgcgtaccgcttagttcgggacgtcctttaggaacgtacgtcgggttacgggggcgaacggggttaacccg

SEQ ID NO: 372791 - DNA, 579 bp, Homo sapiens
  misc_feature: GZ8MTXP01EFCI8.44.74.G08.1.454.CMB.2.raw
  modified_base (340)..(340): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtccctcggtgtacccctttcctgcaccgggcctctaggaactactaccagttccactacttataccatcaactgggtgcgccaggcccctggacaaggcttgagtggagtggtgaatcattccctnttttggctccactcacctacgcaacgagcttccggggcagatacgatacgcgacaagtcacagacacagtctccatcgacaatgtagtttcttagaaactccgaacgtacaccgggcccttactaacctactcgtagccggaaggtaacgggttccccgttaacccgcgttacgtccgacacgttcgggacgtccgtttaggcggtactcgggttcgggggaacgaacggggtaacccg

SEQ ID NO: 372792 - DNA, 536 bp, Homo sapiens
  misc_feature: GZ8MTXP01ESLCY.44.74.G08.1.454.CMB.2.raw
  modified_base (273)..(273): a, c, t, g, unknown or other
  modified_base (337)..(337): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgtacccctttcctgcacggcctctggaagtactaccagttccactacttanaccatcaactggtgcgccacggcccctggacaaggcttgagtggatgggtgaatcattcccttntttggctccactcactcgcaacgagcgttcggggcagatacgataccgcgacaagtccacagacacagtctaccatgacaatgagtttcgttagaaactccgacgacaccggcctctactactgtgcgagcggtccgttacccagctcgcagttcggacgtcctttgcgtagtcggttagggggcaacggggtaacccg

SEQ ID NO: 372793 - DNA, 542 bp, Homo sapiens
  misc_feature: GZ8MTXP01DVKZJ.44.74.G08.1.454.CMB.2.raw
  modified_base (273)..(273): a, c, t, g, unknown or other
  modified_base (338)..(338): a, c, t, g, unknown or other
  modified_base (405)..(405): a, c, t, g, unknown or other
  modified_base (508)..(508): a, c, t, g, unknown or other
  modified_base (515)..(515): a, c, t, g, unknown or other
  modified_base (518)..(518): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgcggtggcagcagcaacaggtgtccagtccctggtgcaactggtgcagtctgggactagaatgccgcaaccttggtcctcggtcgtaccctttctgcacggtcctctggaactactaccagttccactacttanaccatcaactggtgcgccaggcccctggacaaggcttgagtggagtgggtggaatcattcccttnttttgctccactcacctacgcaacgagcgttccggggcaagtaatacgattaccgcgacaagtccanagacacagtctcatgacatagtagtttcttagaaatccgacgacaccggtcctactactacgtgtgcgagtaacggtcccgttacccagctcgcagttggacnccttagngtntcggttggggcgaacggggtaacc

SEQ ID NO: 372794 - DNA, 596 bp, Homo sapiens
  misc_feature: GZ8MTXP01CDGWI.44.74.G08.1.454.CMB.2.raw
  modified_base (233)..(233): a, c, t, g, unknown or other
  modified_base (271)..(271): a, c, t, g, unknown or other
  modified_base (570)..(570): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcngcacggcctctggaactactaccagttccactacttanaccatcaactgggtgccgccgacggcccctggacgaaggcttgagtggatgggtgaatcattcccttgttttgctcccactcacctacgcaacgagccgttccgggacagtaatacgactaccgacggtacaagtccaacagaacacgagtcctaccatagaacaatgagtttcgttaagaaacgttccgaacgacgaccggtccctattaacccgtagtcgtgacgaggtaaccggtccccgttacccagccgttaccgcgttaagttcgggaacgttccttaggaagtacgttcggngggggaaccttaacggggttaacccg

SEQ ID NO: 372795 - DNA, 635 bp, Homo sapiens
  misc_feature: GZ8MTXP01BGW81.44.74.G08.1.454.CMB.2.raw
  modified_base (273)..(273): a, c, t, g, unknown or other
  modified_base (320)..(320): a, c, t, g, unknown or other
  modified_base (342)..(342): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttctgcacggcctctggaacgtactaccagttccactacttanaccatcaactgggtgcgccacggcccctggacaaggcttggagtggngtgggtggaatcacttcccttnttttggctccactcacctcgcaacgacgcgttccgggacagacttacgacttaccgcggacaagtcccaacgacgaccacgagtcctaccatcgaactaatgttacgtttcgtttaagaaacttccggaacgaccgaccggtcccgttactaaccgttacgtggttacggcggaacggtaaccggttccccgttaccccgacgttccgttaccggcttacgttcgggttacgtcccgttttaggaacgttacggtcgggttacggggggaaccgttaaccggggttaaccccg

SEQ ID NO: 372796 - DNA, 570 bp, Homo sapiens
  misc_feature: GZ8MTXP01CIE8M.44.74.G08.1.454.CMB.2.raw
  modified_base (232)..(232): a, c, t, g, unknown or other
  modified_base (270)..(270): a, c, t, g, unknown or other
  modified_base (505)..(505): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcngcacggcctcgtggaatactaccagttccactacttanaccatcaactggtgcgccaggcccctggacaggctgagtggatgggtgatcatcctcttttggctccactcacctacgcaacgacgaaccgttcggggactagaattacgacgttaccgacgaactaacgtccacgaacgacacacgtctccatgaacaatgtagttacgttagaaacttccgacgacgaccgtccgtctactactgtacgcgaggaacggtcccgttaaccccngaccgtcgcacgttcggactccgtttagaagtgtacggttcgggggaacgaacgggggtaacccg

SEQ ID NO: 372797 - DNA, 559 bp, Homo sapiens
  misc_feature: GZ8MTXP01D6DZE.44.74.G08.1.454.CMB.2.raw
  modified_base (272)..(272): a, c, t, g, unknown or other
  modified_base (336)..(336): a, c, t, g, unknown or other
  modified_base (403)..(403): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctctggaacgtactaccagttccactacttanaccatcaactgggtgcgccaggcccctggacaaggcttgagtggagtgggtgaatcattccttnttttgctcactcacctacgcaacgagcgttccggggcaagaacttacgattaccgcggacagtccanagacacagtctccatgacaatgtagtttctttagaaattccgacgacacgccgtctactctgtgcgagaacggtcccgttaccccagccgtcggccagttcggacgtcccgtttagaacgtacgtcgggttcgggggtccgaacggggttaacccg

SEQ ID NO: 372798 - DNA, 560 bp, Homo sapiens
  misc_feature: GZ8MTXP01BARCT.44.74.G08.1.454.CMB.2.raw
  modified_base (277)..(277): a, c, t, g, unknown or other
  modified_base (287)..(287): a, c, t, g, unknown or other
  modified_base (318)..(318): a, c, t, g, unknown or other
  modified_base (351)..(351): a, c, t, g, unknown or other
  modified_base (387)..(387): a, c, t, g, unknown or other
  modified_base (398)..(398): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccgaggggaaagagccaccctctcctgcagggccagtcagagtgttgaccaaaatcttagtctggtccagcagaacctggcagactccagctcnatctatggtncatccagcagggcctcgtggcactcccgganaggttcaggtggctaggtggggtctggggaacnggaaccttcaactctcaccatcgagcaagctggacnctagaaagttntttagacttagtttatacgtgtacacgtcctacgggactaaaggtacgtcgacctaactaattacttccgtaccgtttccggacccgtagggaaacctaaagggttcgaataacacgaaacgtacgttggttcgctaagaccaactgttcttcgttcttctc

SEQ ID NO: 372799 - DNA, 651 bp, Homo sapiens
  misc_feature: GZ8MTXP01D8FF9.44.74.G08.1.454.CMB.2.raw
  modified_base (232)..(232): a, c, t, g, unknown or other
  modified_base (268)..(268): a, c, t, g, unknown or other
  modified_base (349)..(349): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcngcacggcctctggaatactacagttccactacttanaccatcaactgggtgccgccgacggccccctaggacgaagggtcttggaggttgggagtggggtaggaatcacttcccttntttttggctccactcacctacgccaacgacgtccgttcggggacaagtaacttacgacttaccggacggaacaacgtccaacgagaaccaacgaacgtcctaccatacgaacaagttagtagtttccgtttaagaaacttcccggaacgaccgaaccgggtcccttaacttaaccgtacgtcggttacgaccggaacggtaaccggttccccgttaaaccccgaggttccctcggaccttaaggttcgggacgttccgtttaggaagtacgtcggttacgggggaacaacggggttaacccg

SEQ ID NO: 372800 - DNA, 587 bp, Homo sapiens
  misc_feature: GZ8MTXP01CF1CE.44.74.G08.1.454.CMB.2.raw
  modified_base (234)..(234): a, c, t, g, unknown or other
  modified_base (244)..(244): a, c, t, g, unknown or other
  modified_base (273)..(273): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttccngcacggcctntggaacgtactaccagttccactacttanaccatcaactgggtgcgccacggcccctggacaagggcttggagtggagtgggtgaatcactcccttgttttggctccactcacctacgcaacgagcgtccgggcagtaatacgactaccgcgaacagtaccacagacacacgtctacatcgaacaatgtaacgtttcgtttagaaacgtccgaacgtacgaccggccgtactactacctgtcgcggagtcggtcccgttacccgagttccgtccggcaggttcggacgttcccgtttaggaacgtacgtcggttcggggggaaccgttaacggggtaacccgg

SEQ ID NO: 372801 - DNA, 720 bp, Homo sapiens
  misc_feature: GZ8MTXP01CJARL.44.74.G08.1.454.CMB.2.raw
  modified_base (195)..(195): a, c, t, g, unknown or other
  modified_base (283)..(283): a, c, t, g, unknown or other
  modified_base (293)..(293): a, c, t, g, unknown or other
  modified_base (381)..(381): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccgaggggaaanagcccaccctctcctgcagggccagtcagagtgttagaccaaaaactcttagtctggttccagcagaacctggccagctccagctctnatctatggtncatccagcgagggcctcgtggcacgtccccggagtacggttcaggtcggcgagggttcggggtcgtaggggacaggtaacctttaccncttcctaccacccatcgagccaagaccgtgggacgtccgtaggtaaagttgttttacggacgttaaggttcgttaacgtttaaccgttcggttacgaacgtacggtaaggtttaacgttcgtacccgttttaacctccctaaccccgtttcgttaccggtaaccgggtttcccggggaaacccggtaaaacgggggtaacccgtaaaagggggttaaacggaaaaccgttaaaccggaaaaaccggttaaacggttcgggttaacggggttccttaacggaaccctaaccccgttaatttccgttacggtttccttcccgttaaccgttttccccccgg

SEQ ID NO: 372802 - DNA, 708 bp, Homo sapiens
  misc_feature: GZ8MTXP01COFQK.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagaatgccgctaaccgttggtcctcggtcgtacccctttctgccacggtccttcgtagggaaacgttacctacctacgttacccacttaacttaacaccataccaacgtgggtcgccgccgacggcccctaggacgaaggcttggagtggagtgggtaggtaactcgtacttcccgtttcgttttacggcttacccacctactaacccgtaccgacgaaacggaacgtccggttccggggactaaacgtaacttacgaacgttaccgacggtaacaacgtacccaagacgaaccacgacgtcctacagttagaaactaagtgtacgtttacgtaacgtaaacgtccgaacgtaacgaccgggtcccttataaccgtacgttcgacgaccggtaacggtaacccggttaccccgacccgagttccgtaccggtcgttaacggttcgggaacgtttccgtttaggaacgttcggtcggggttacgggggaacccgttaacgggggttaacccg

SEQ ID NO: 372803 - DNA, 647 bp, Homo sapiens
  misc_feature: GZ8MTXP01DILYQ.44.74.G08.1.454.CMB.2.raw
  modified_base (136)..(136): a, c, t, g, unknown or other
  modified_base (244)..(244): a, c, t, g, unknown or other
  modified_base (290)..(290): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctntttgtggtggcagcagcaacaggtgtccagtccctggtgcaacgtggtgcagtctgggaactagaatcgccgactaaccgtttggtcctcggtcgtaccccttttccngcgacggccttcgtaggaagtacctacctagttccaactacttaanaccatacaacgtgggtagccgaccgacggcccccgtaggaccgaaagggcttgaggtaggagtgggtaggaaactcgattcccttctttttggctcccactcacctacgcaaacgagccgttccggggactaagaatttacgacgttaccgacggaacaagtaccaacagaacacgacgtcctacataacactaagtagtagttacgttaacgtaacgtaaccgaacgaccgaccgtaccgtacgtactacgtacgtacgacgacggtaaccggtacccgttacccgacgcgtacgacgttacgttcgttacgtcgtagtaacgtacggtcggttacgggtaacggaacggtaaccg

SEQ ID NO: 372804 - DNA, 557 bp, Homo sapiens
  misc_feature: GZ8MTXP01B1WUU.44.74.G08.1.454.CMB.2.raw
  modified_base (270)..(270): a, c, t, g, unknown or other
  modified_base (338)..(338): a, c, t, g, unknown or other
  modified_base (410)..(410): a, c, t, g, unknown or other
  modified_base (456)..(456): a, c, t, g, unknown or other
  modified_base (525)..(525): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaatactaccagttccactacttanaccatcaactgggtgcgccaggcccctggacgaagggcttgagtggagtgggtggaatcattcccttnttttggctccactcacctacgcaacgagtccgttccggggacagtaacttacgattaccgcggacagtccanagacacagtctccatgacaatgagtttcttagaaactccgacgacncggccgtctactactggtcgcgagaacggtccccgttacccagctccgcagttggacgtccgtttaggngtagtcggttgggggccaacgggggtaacccc

SEQ ID NO: 372805 - DNA, 724 bp, Homo sapiens
  misc_feature: GZ8MTXP01AHH66.44.74.G08.1.454.CMB.2.raw
  modified_base (221)..(221): a, c, t, g, unknown or other
  modified_base (230)..(230): a, c, t, g, unknown or other
  modified_base (336)..(336): a, c, t, g, unknown or other
tcagacagtatatacacgaccggtgctcgatttagtagctctatcaggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaacttggtcctcggtnaccctttcngcacggcctctggaagtactaccagttccactacttacaccatcaacgtgggtcgcgccacggcccctggacaggcttggagtggagtgggtgaatcattcccttnttttggctccactcaccgtacgcgaacgacgtcgttccggggactaaggtaaactttacgaacgtttacccgggacggtaacctaaacggttcccaaacgacggaacctaacgtacggttaccctacccgaagttacgaaaccgtaaagttacggtaacgttttacggtttaacggaaaaccgttcccggaaaccggtaaccgtacccgggtcccgtttacgttaaaccgttacgtcgggttacgaccggtacggtaacccgggttaccccgttaccccgtacggttcccgttacgtaccgttacggttcgggttaccgttcccgttttagggaacgttcggttaccggggttacggggggtccgttaaacccgggggtttaaccccg

SEQ ID NO: 372806 - DNA, 545 bp, Homo sapiens
  misc_feature: GZ8MTXP01CUI0B.44.74.G08.1.454.CMB.2.raw
  modified_base (234)..(234): a, c, t, g, unknown or other
  modified_base (272)..(272): a, c, t, g, unknown or other
  modified_base (497)..(497): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttccngcacggcctctggaagtactaccagttccactacttanaccatcaacgtggtgcgccacggcccctggacaaggcttggagtggatgggtgaatcattcccttcttttgctcccactcacctacgcaacgagcgttccgggacagatacgataccgcgacagccacagacacagtctacatgacaatgatttcttagaaacttcccgaacgaccgacggcccgttctactactgtcgcgaggcggtcccgacccagcgtacgnagttggacgtccttgcgtagtcgggcgggggtcgaacggggtaacccg

SEQ ID NO: 372807 - DNA, 625 bp, Homo sapiens
  misc_feature: GZ8MTXP01D7XC6.44.74.G08.1.454.CMB.2.raw
  modified_base (280)..(280): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtcgtgggactagaatgccgctaaccgttggtcctcggtcgtaccctttctgcacggtcctgtaggaacttactacctagttccactacttanaccatcaacgtggtcgcgccacggcccctaggacgaaggcttgagtggagtgggtagaatctacttccttgttttgcttccactcacctacgcaacgagtcgttcgggacagtaactacgactacgcgaacagtaccagagacacacgtctaccatagaactaagtgtacgtttcgtttaagaaacttcccgaacgacgtaccggtccctacttaaccgtctggtacgacggtaaggtaacccgggttccccgttaaccccgagttcccgttacgcgttaacggttcgggaacgttccgtttagaagttacgtcgggttacgggggcttaaccgggggtaacccg

SEQ ID NO: 372808 - DNA, 697 bp, Homo sapiens
  misc_feature: GZ8MTXP01B2EKR.44.74.G08.1.454.CMB.2.raw
  modified_base (283)..(283): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagatgccgcaaccttggtcctcggtcgtacccctttcctgccacggtccttcgtaggaacgttacctaccacgttccaactacttanaccatacaacgtgggtcgccgccgacggccccgtggacgaagggcttaggaggtggagttggggtaggaactcgtacttcccctttgttttcggcctaccacctcaccctacgcaaacgacgtccgtccggggacaagtaacttacgacgttaccgacggacacgtaccagacgacactacgtcctaccagtacgaactaagttcgtaacgtttacgtttaacgaaaacgttcccggaacgtaaccgaccggtacccgttaactaaccgttacgtcggtacgtaccgaacgggtaaccggttaccccgttacccgacgttcccgtacggtacttacggttcgggacccgttaacgtttacgggaacggttacgtccggggttacgggggaacccgttaacgggggttaaccccg

SEQ ID NO: 372809 - DNA, 593 bp, Homo sapiens
  misc_feature: GZ8MTXP01C2H94.44.74.G08.1.454.CMB.2.raw
  modified_base (435)..(435): a, c, t, g, unknown or other
  modified_base (523)..(523): a, c, t, g, unknown or other
tcagacagtatatacacgaccggtgctcgatttagtagctctatcagggggagacttcccttcctatgataagagaggcctggaggttcctccttagctgtgggctcagaagcagagttctggggtgtctccaccatggcctggacccctctctggctcactctcctcactctttgcatagggtctgtagtttcttctgggctgactcaggatctgctgtgtctgtggccttgggacagacagtcaaagatcacatgccaggagacagcctcaggaggcactatgacaagctacggtaaccaacgagaacggccgggacacggcccctctacttgtccatagtttacggaaaaccgcccggcccgtaccgggctcccagaccgtacttcactcgcctccacctcaaggaacacagacctttaccttacgacctancacgtacgggacctacggacgggcggtaaagagtaggacggacgtagtaaccttattacttggacctagctaacggttcccggggaanaggttaacgtattggttctttacgttgtttacgccgtaaccgggacttaacggtcccgttaacgttccgg

SEQ ID NO: 372810 - DNA, 813 bp, Homo sapiens
  misc_feature: GZ8MTXP01AWW8G.44.74.G08.1.454.CMB.2.raw
  modified_base (205)..(205): a, c, t, g, unknown or other
  modified_base (234)..(234): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccncaaccttggtcctcggtcgtaccctttcngcacggcctgtggaactactaccagttccactacttacaccatcaacgtggtgccgcccgacggcccccgtagggaaccgaaggggtcctttaggacggtagggaagttgggggtacggtaaacgtcctacgtttccccgtttcgtttttttcgggccttacccccgtaccttaccgtaacccgtaacccggcccgtaaaaccgggtaacgggtaacccgtttacccggggggactaaacgggtaaacgttttaaccggaacgtttaacccgggaccggggtaaaccctaaacggttaccccaaacgaacggaaaccctacgtaacggttacccttaacccaaagttacggaaacctaaagtttacggtaacgtttttacggtttaacgaaaaccgttccccggaaacgtacccgaacggggtccccgttaacgttaaccttaccgttggtacggaccggaaggtaacccgggttccccgttacccccaagggttcccttacgggacttacggttgggaccgttcccgtttagggaagtcgttccgggggacgggggttaaccgaacggggtaaccccg

SEQ ID NO: 372811 - DNA, 600 bp, Homo sapiens
  misc_feature: GZ8MTXP01BR3VD.44.74.G08.1.454.CMB.2.raw
  modified_base (278)..(278): a, c, t, g, unknown or other
  modified_base (343)..(343): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccgtttggtcctcggtcgtacccctttctgccacggcctcgtaggaacgtactaccagttccactactanaccatcaactggtgcgccaggcccctggacaagggcttggagtggagtgggtgaatcatcccttnttttggctccactcacctacgctaacgagcgttccggggcagtaatacgacttaccgacggaaccaagtaccaacacgaaccacgaacgtcctaccatacgaactaagtgtagtttaccgtttagaaacgttcccggaacgaacgtccggacccgttctaaacctcgtgtcgacgagtaacggtcccttaccccgagccgtcgcttaagttcggacgtcccgtttgaagtacgtgttcgggggcaacgggtaacccg

SEQ ID NO: 372812 - DNA, 540 bp, Homo sapiens
  misc_feature: GZ8MTXP01C5XJ4.44.74.G08.1.454.CMB.2.raw
  modified_base (269)..(269): a, c, t, g, unknown or other
  modified_base (326)..(326): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggagttcctctttgtggtggcagcagcaacaggtgtccagtccctggtgcaactggtgcagtctgggactagaatgccgcaaccttggtcctcggtgaccctttctgcacggcctctggaagtactaccagttccactacttanaccatcaactggtgcgccaggcccctggacaaggctgagtggatggtgatcatcctntttgctccactcacctcgcaacgatcgttccggggcaagaatacgattacgcgacagtcacagacacagtctcatgacatgagttctttagaaacttccgacgacacgggtcctctactactgtgcgtagaacggtcccttacccgagcgtcgcttagttgggacgtccctttggaacgtaagtccgggttagggggtcgaacggggtaacccg

SEQ ID NO: 372813 - DNA, 577 bp, Homo sapiens
  misc_feature: GZ8MTXP01CLM2O.44.74.G08.1.454.CMB.2.raw
  modified_base (269)..(269): a, c, t, g, unknown or other
  modified_base (283)..(283): a, c, t, g, unknown or other
  modified_base (334)..(334): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctctggaaatactacagttccactactanaccatcaactggtncgccaggcccctggacaaggcttgagtggagtgggtgaatcgtatcccttnttttggctccactcacctacgcaacgagtccgttccggggcaagaattacgaacttaccgacggacaagtccacagacacagtctaccgaatgactaatgtacgtttacgtttacgaaacttccgaacgacaccggccgttactacgtactgtcgcgaggtaaccgtccgttacccagccgtacgcaagttgggacgtccgtttagaacgtagtcggttcgggggaacaacggggtaaccccg

SEQ ID NO: 372814 - DNA, 719 bp, Homo sapiens
  misc_feature: GZ8MTXP01DNWAV.44.74.G08.1.454.CMB.2.raw
  modified_base (697)..(697): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggagttcctctttgtggtggcagcagcaacaggtgtccagtccctggtgcaacgtggtgcagtctgggactagaatgccgcaacctttggtcctcggtcgacccctttctgcacggcctcgtagggaacttactaccagttaccactacttataccatcaacgtgggtcgccgccgacggcccctaggaaccgaagggtcttggaggtggagtgggggtaggtaaactcgtaacttccccttcgtttttcggccttacccgtaccttactaaccccgttaaccggacctaaaccgggtaacggtaacccggtttacccgggggaacctaaaggttaaacgttaaccggtaaacgtttaaccccgggaaccgggtaaacctaaacggtacccaacgaaacggaaccaaccgaacggttacctaccaagttacgaacctaaagtgttaacgttttacgtttaacgaaaacttcccggaaccgtacgaccggtaccgttactaacctactggtcgacgagtaaccggtcccgttaacccagctcgcttagttggactcgttagaacgtgtccggnggggaacttaacgggtaacccg

SEQ ID NO: 372815 - DNA, 528 bp, Homo sapiens
  misc_feature: GZ8MTXP01AVWPY.44.74.G08.1.454.CMB.2.raw
  modified_base (270)..(270): a, c, t, g, unknown or other
  modified_base (329)..(329): a, c, t, g, unknown or other
  modified_base (499)..(499): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaatactaccagttccactacttanaccatcaactggtgcgccaggcccctggacaaggcttgagtgatgggtgaatcatcctntttgctccactcactacgcaacgacgcgtccggggcaagacttacgataccgcgacaagtccacagacacagtctccatgaacaatgtagtttcttagaaatccgacgacacgccgtatactactgtgcgagaacgtccttacccagccgtcgcagttggacgtccttgngtactcggttcggggcaacggggtaaccc

SEQ ID NO: 372816 - DNA, 606 bp, Homo sapiens
  misc_feature: GZ8MTXP01E1IIL.44.74.G08.1.454.CMB.2.raw
  modified_base (573)..(573): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgctaaccttggtcctcggtcgtaccccttttctgcaccggcctctgggaattacctaccacgttccactacttactaccatcaacgtggtgcgccacggccccgtcggacgaaggcgtggaccccgtggagtgggtaggaagtctacttccttctttggtctcccactcacctacgccaacgacgtccgttccgggacgtagtaacgttaacgtacgttaccgacggaacaacgtaccaacgacgaacacgacgtactaccatacgaactaatagtagtttacgttacgtaaactaccgacgacgacgccgtactactactgtgcgagcggtccgttacccgacgcgtacgcagttggacgtccttagngtacgtcggttacggggccgaacgggtaacccg

SEQ ID NO: 372817 - DNA, 599 bp, Homo sapiens
  misc_feature: GZ8MTXP01BDEKL.44.74.G08.1.454.CMB.2.raw
  modified_base (278)..(278): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagatgccgctaaccgttggtcctcggtcgtacccctttctgcaccggtcctcgtggaacgtactaccagttccactacttanaccatcaacgtgggtgccgccgacggcccctaggacaagggcttggagtggagtggggtaggaatctacttcccttgttttcggctcccactcacctacgcaacgagcgttccgggatagaactacgattaccgcgtacaagtccaacagacacgagtcctacgatgaactaatgtacgtttcgttacgaaatcccgaagtaccaccgggtcctactacgtacgtggtcgacggagtaaccggtcccgacccaggccgtcgattacggttggacgtaaccgtttgaaggtcttcggggcggggcgttaacggggtaacccg

SEQ ID NO: 372818 - DNA, 637 bp, Homo sapiens
  misc_feature: GZ8MTXP01CXE0S.44.74.G08.1.454.CMB.2.raw
  modified_base (276)..(276): a, c, t, g, unknown or other
  modified_base (432)..(432): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccctttcgtgcacggcctcgtaggaactactactacgttccactacttanaccatcaacgtgggtcgccgccgacggcccctaggacgaagggtcttggagtggagtggggtagaatctacttcccttgttttggctccactcacctacgcaacgacgtcgttccggggactaagtaacttacgacttaccgacgacaacgtccanactacactacgtcctccaagtcgaacaagttgtagtttctttaacggaaacgttacccgacgtaaccgaccggtccttacgtaacctacgtgtacggcgtacggtaaccggtccccgttacccaggccgtacgcttaagttcggacgttccgtttagggaacgtacggttcgggttacgggggtaaccgttaacggggtaacccg

SEQ ID NO: 372819 - DNA, 659 bp, Homo sapiens
  misc_feature: GZ8MTXP01BCIYJ.44.74.G08.1.454.CMB.2.raw
  modified_base (240)..(240): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtcgtgggactagaatcgccgactaaccgttggtcctcggtcgtacccctttcngcaccggcctcgtaggaacgtacctacctacgttccaactacttacaccatcaacgtgggtcgccgccgacggccccgtaggacgaaggcttggagtggagtgggtagaatcacttccttgtttgctccactcacctacgcaacggacgtcgttccgggacaagtaacttacgacttaccggacgacaacgtccaacgacgacactacgtccactatagaactaagtgtaacgtttcgttaagaaactcccgaacgacgaccggtccttactaccgttacgtggtacgcggtaacggtaaccggtccccgttaccccgagttccgtaccgacgttacggttcgggttaccttccggtttaggaacggttacggttccggggttacggggggtaacccgttaaaccgggggtttaacccg

SEQ ID NO: 372820 - DNA, 626 bp, Homo sapiens
  misc_feature: GZ8MTXP01B4TTY.44.74.G08.1.454.CMB.2.raw
  modified_base (271)..(271): a, c, t, g, unknown or other
  modified_base (341)..(341): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctctggaagtactaccagttccactacttanaccatcaactgggtgcgccgacggcccctggacaagggtcttggagtggagtgggtgaatcacttccttnttttggctccactcacctacgctaacgacgtcgttccggggacagtaactttacgacgttacccggacggaacaacgtcccaacgacggacacacgtcctaccagtacgaacaagttacgtacgtttcgtttaagaaacgttcccgaacgaccgaccggtcccgttacttaacctacgtggtacggccgaaggtaacgggttccccgaccctaggcctccgcgagttcgggacgttcctttaggcgtacgttcgggcgggggtaaccttaacgggggtaaccccg

SEQ ID NO: 372821 - DNA, 802 bp, Homo sapiens
  misc_feature: GZ8MTXP01COZ3A.44.74.G08.1.454.CMB.2.raw
  modified_base (205)..(205): a, c, t, g, unknown or other
  modified_base (234)..(234): a, c, t, g, unknown or other
  modified_base (244)..(244): a, c, t, g, unknown or other
  modified_base (271)..(271): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccncaaccttggtcctcggtcgacccctttcngcacggcctntggaatactaccagttccactacttanaccatcaacgtgggtgccgccacggcccctggaccaagggcttgaggtggagtggggtaggaatcgacttccccgttagtttttcggccttccctacttccaccttaccgccaaaccgggtacgtcccgtttcccgggggactaacgtaacgttacgtaacgtttacccgggaccgggtaactaacggtacccaacgacgaccaccgtacgtaccttaccaacttcggaaaccctaagttcggttaaacggttttaccggttttaacggtaaaaccggttccccgtaaaccgggaaaccccgtaacccgggggtccccttaccgttaaccgttaaccgttcgggtacggtacccggaacgggttaaccggggtaaccccccggttacccccgttaaacgggccccgttaccgggtaacccgttacggttcgggggttaaaccggtttccccgtttttaggggaacgggttaaccggtttcccgggggttacggggggggtcccttaaacccggggggtttaaacccccggg

SEQ ID NO: 372822 - DNA, 553 bp, Homo sapiens
  misc_feature: GZ8MTXP01DD4MX.44.74.G08.1.454.CMB.2.raw
  modified_base (271)..(271): a, c, t, g, unknown or other
  modified_base (287)..(287): a, c, t, g, unknown or other
  modified_base (391)..(391): a, c, t, g, unknown or other
  modified_base (403)..(403): a, c, t, g, unknown or other
  modified_base (420)..(420): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgtaccctttctgcacggcctctggaagtactaccagttccactacttanaccatcaacgtgggtncgccacggccctggacaaggcttgagtggatggatggatcacttcctcttttggcctcactcacctacgcacgcgacgtccggggacagaattacgattaccgngaacacgtccanacgacacagttccacangaactaatcgtagtttctttagaaactccgaacacgcgtcgtactactacgtgtcgcgaaggtcgttcccgtacccagcctcgacttgttacggcgtcgtttgagtacgttcggttcgggggcgtaaccgggg

SEQ ID NO: 372823 - DNA, 744 bp, Homo sapiens
  misc_feature: GZ8MTXP01ADDSJ.44.74.G08.1.454.CMB.2.raw
  modified_base (234)..(234): a, c, t, g, unknown or other
  modified_base (275)..(275): a, c, t, g, unknown or other
  modified_base (342)..(342): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttccngccacggcctcgtggaacgtactaccagttccactacttanaccatcaactgggtgcgccacggcccctggacaagggcttgagtggagtgggtgaatcattcccttnttttgctccactcaccgtacgcaacgacgtccgttccggggactaagtaacgttaccgaacgttacccggaccgggaaacctaacggtacccaacgaaacggaacccaacgtaacggttccctacccgaagttacggaaacctaaagtttcggtaacgttttaccggttttaaggaaaaccgtttaccccggaaacccgggtaaccgtacccggggtaccccgtttacgttaaacccgttaaccgttcgggtacggtaccggtaacgggtaaccggggttacccccgttaacccccggagttccccgttaccggaccgttaggttccgggttaacgttccccgtttaggaacgtacggttccggggttacggggggaaccgttaaccgggggttaaccccgg

SEQ ID NO: 372824 - DNA, 602 bp, Homo sapiens
  misc_feature: GZ8MTXP01B97Z1.44.74.G08.1.454.CMB.2.raw
  modified_base (243)..(243): a, c, t, g, unknown or other
  modified_base (269)..(269): a, c, t, g, unknown or other
  modified_base (342)..(342): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttctgcacggcctntggaatactacagttccactacttanaccatcaacgtgggtgccgccgacggcccctggacaagggcttggagtggagtgggtagaatcacttcccttnttttggctccactcacctacgcaacgacgcgttccggggacagtaacttacgacttaccgacggaacaacgtccacagaccacacgtcacatgactaatgtacgtttacgtttagaaactccgaacgacaccggccttacttaacctacgtgtcgaccgaaggtaaccggtacccgttacccgagccgtacgcaagttcgggaacgttccgtttaggaacgtacgtcgggttacgggggaaccgttaacggggtaacccg

SEQ ID NO: 372825 - DNA, 634 bp, Homo sapiens
  misc_feature: GZ8MTXP01DTKST.44.74.G08.1.454.CMB.2.raw
  modified_base (562)..(562): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtcgtgggactagaatcgccgcaaccttggtcctcggtcgtacccctttcctgcaccggcctcgtaggaacttacctacctacgttccactaacttataccatacaacgtgggtcgccgccgacggccccgtaggacgaagggtcttggagtggagtgggtgaatcacttcccttcttttggctccactcacctacgcaacgagtcgttcggggcaagacttacgattaccgacgacaacgtccacagaccacacgtctaccagtacgaactaattgtacgttttacgtttaacgaaacgttcccgaacgaccgtacccgggtcccttactaaacgttacgtgtacggcgaaggtaaccggtcccgttaaccccgngttccgtcgacaggttcggttacgtccgtttgaagtacgtcggggacgggggtccgaacggggttaaccccg

SEQ ID NO: 372826 - DNA, 592 bp, Homo sapiens
  misc_feature: GZ8MTXP01EY3C1.44.74.G08.1.454.CMB.2.raw
  modified_base (278)..(278): a, c, t, g, unknown or other
  modified_base (387)..(387): a, c, t, g, unknown or other
  modified_base (424)..(424): a, c, t, g, unknown or other
  modified_base (525)..(525): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttcctgccacggccttctggaacgtacctaccagttccactacttanaccatcaacgtggtgcgccacggcccctggacaagggcttgagtggagtgggtggaatcattcccttgtttttggctccactcacctacgcaacgacgcgttccggggnagtaacttacgactaccgcggacaagtccacagacanacgctaccgatcgacaatgtactttcgtttagaaactcccgaacgaccgtaccggcccttacttaactcgtgtcgacgaggtccggtccccttaaccccgngttacctcggacagttcggcgttccttggaagtacggtcgggttcgggggtcgaaccgggtaacccg

SEQ ID NO: 372827 - DNA, 552 bp, Homo sapiens
  misc_feature: GZ8MTXP01CBY6K.44.74.G08.1.454.CMB.2.raw
  modified_base (272)..(272): a, c, t, g, unknown or other
  modified_base (332)..(332): a, c, t, g, unknown or other
  modified_base (473)..(473): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctctggaagtactaccagttccactacttanaccatcaactgggtgcgccaggcccctggacaaggcttgagtggatgggtgatcatcctnttttggctcactcacctacgcaacgagcgttccggggcagaatacgacttaccgcggacaagtcacacgacacagtctaccatcgacaatgtagtttctttagaaatcccgaacgacacggccgtctactactgtcgacgngaacggtcccgttacccagctacgcttagttcggactcctttggaacgtacgttcggcgggggcgaacggggtaacccg

SEQ ID NO: 372828 - DNA, 717 bp, Homo sapiens
  misc_feature: GZ8MTXP01ATZQW.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtcgtgggactagaatcgcccgactaaccgttggtccctcgggtcgtaccccctttccgtgccaccgggtccctcgtagggtaaacttacctacctacgttccctacttaacttactaccataccaacgtgggtcgccgccgacggccccgtggaccgaagggtcttgaggtggagtggggtaggaactctacttcccttcgtttttggcctccctacctactaccctaccgcaaaccggacgtccgttccggggacaagtaacttacgacgttaccgacggaacaacggtcccaacgacgaccactacgtcctaccatacgacaagttgtacgtttcgtttaagaacgttccgaacgtacgaccgggtcccttacgtacctacgttcggtacggaccgaacggtaacccggtccccgttaaccccgaacggttcccgttacggacccgttagttcggggaaccgttcccgtttaaggcggttaggttccgggttacggggggaacccgttaaccgggggttaaccccgg

SEQ ID NO: 372829 - DNA, 633 bp, Homo sapiens
  misc_feature: GZ8MTXP01C3SRZ.44.74.G08.1.454.CMB.2.raw
  modified_base (234)..(234): a, c, t, g, unknown or other
  modified_base (244)..(244): a, c, t, g, unknown or other
  modified_base (273)..(273): a, c, t, g, unknown or other
tcagacagtatatacacgaccggtgctcgatttagtagctctatcagggggagcatcacataacaaccacattcctcctctaaaagaagcccctgggagcacagctcatcaccatggactggacctggaggttcctctttgtggtggcagcagcaacaggtgtccagtccctggtgcaactggtgcagtctgggactagaatgccgcaaccgttggtcctcggtgaccctttcngcacggcctntaggaagtactaccagttccactacttanaccatacaacgtgggtcgcgccgacggccccgtaggacgaagggcttggagtggagtgggtaggaatctacttcccttgtttttcgcttccactcacctacgcaaacgacgtccgttccggggacaagtaacgttacgacgttaccgacggaacaacgtccaacacgacacgacgtcctcaatagactaatgtacgtttacgttaagaaacttcccgaacgaccaccgggcccttactaactctggtagccggaaggaaccgggttccccttaaccccgaggccgtcggacacggttcgggaacgtttccgtttaggaagtacggttcgggttacgggggaaccgaacggggtaacccgg

SEQ ID NO: 372830 - DNA, 583 bp, Homo sapiens
  misc_feature: GZ8MTXP01EPWGK.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagaatgccgcaacctttggtcctcggtcgtaccctttcctgcacggtcctcgtaggaagtactaccagttccactacttataccatctaacgtggtcgcgccacggcccctaggacgaacggtcttgagtggagtgggtgaatctatcccttctttgctcgactcactacgcaacgagtcgttcggggacagtaacttacgacgttaccgacgaacacgtaccagagacactacgtctaccatcgaactaagtgtagttcgtttagaaactccgaacgacgaccgtcgtactactacgtgtacgcgaggcgtcccgttacccagcgtacgcaagttcggacgtccttaggaacgtagtcggttcggggaacttaacggggtaaccg

SEQ ID NO: 372831 - DNA, 609 bp, Homo sapiens
  misc_feature: GZ8MTXP01CJVXP.44.74.G08.1.454.CMB.2.raw
  modified_base (437)..(437): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagaatgccgcaaccgttggtcctcggtcgtaccctttccgtgcgacggtcctcgtggaacgtactacctacgttccactacttactaccatcaacgtggtcgcgccgacggcccctggacgaaggtctgagtggagtgggtaggaatctacttccttcgttttcggctccactcacctacgcgaacgacgtcgttccgggacagtactacgacttacgcgacacgtcacagacacagtcncatacgactagtgtacgtttacgttacgaaacgtccgaacgtacgacgtccgtactactacgtggtcgcgaagtaaccggtcccaccccgagttccgtacggcttaggttcggttacggttccgtttagaacggttcgtcgggttcgggggtaacgttaacggggtaacccg

SEQ ID NO: 372832 - DNA, 633 bp, Homo sapiens
  misc_feature: GZ8MTXP01EYNOO.44.74.G08.1.454.CMB.2.raw
  modified_base (235)..(235): a, c, t, g, unknown or other
  modified_base (275)..(275): a, c, t, g, unknown or other
  modified_base (318)..(318): a, c, t, g, unknown or other
  modified_base (426)..(426): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgctaaccgttgtcctcggtcgtaccctttcngcacggcctcgtggaactctacctagttccaactacttanaccatcaacgtgggtgcgccacggcccctggacaagggcttgngtggagtgggtaggaatccattcccttcgtttttcggccttccgacctcaaccctacgccaaacgacgtccgttccggggacaggtaaacttacgtacgttacccggngtaaccaacggtcccaacgaacgaccactaacgctaccgagttacgacctaaagttgtacgtttacgttagaaacgtcccgaacgaccgtaccgggtccctactactacgtgtcgcggtacggtaacggtccccgttacccgagttccgtcggacaggttcggacgttccgtgaagtagtcgggttacggggcgttaacgggtcccg

SEQ ID NO: 372833 - DNA, 588 bp, Homo sapiens
  misc_feature: GZ8MTXP01AD6Y9.44.74.G08.1.454.CMB.2.raw
  modified_base (275)..(275): a, c, t, g, unknown or other
  modified_base (343)..(343): a, c, t, g, unknown or other
  modified_base (429)..(429): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccctttcctgcacggcctcgtggaagtacctaccagttccactacttanaccatcaacgtggtgcgccacgcccctggacaagggcttgagtggagtggggtgaatcacttcccttnttttggctccactcacctacgcaacgacgtccgttccggggacagtaacttacgacttaccgcgacaagtcccacagacacagtcnccatgacaatgtagtttcgttagaaactccgaacgaccacggtcctacgtactacgtgtcgcgtaggaaccggtcccttaccccgagccgtcgccgagttcggacgttccgttaggaacggtacgtcgggttacgggggccgttaacggggtaacccgg

SEQ ID NO: 372834 - DNA, 666 bp, Homo sapiens
  misc_feature: GZ8MTXP01DXZIZ.44.74.G08.1.454.CMB.2.raw
  modified_base (283)..(283): a, c, t, g, unknown or other
  modified_base (301)..(301): a, c, t, g, unknown or other
  modified_base (363)..(363): a, c, t, g, unknown or other
  modified_base (384)..(384): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtcgtgggactagaatcgccgctaaccgttggtcctcggtcgtacccctttctgcacggtcctcgtaggaactacctacctagttccactacttanaccatacaacgtgggtcnccgccgacggccccgtaggacgaaggtcttgaggtggagtgggtagaatctacttccctttntttcgctccactcaccgtacncaacgagtccgtccggggactagtaaactacgacgttaccgacgacaacgtccacagacagacgtctcatagaactaattgtacgtttcgtttaacgaaacttcccggaacgacgtacccggtccgttaacttaacccgtagtcgttacggaaccggaacggtaaccgggttccccttaaccccgagttcccgttccggaccttaaggttcgggaccgttccttttagggaacgttaccgggtcggggttacgggggtaaccgttaacggggttaaccccgg

SEQ ID NO: 372835 - DNA, 544 bp, Homo sapiens
  misc_feature: GZ8MTXP01DIJ1V.44.74.G08.1.454.CMB.2.raw
  modified_base (271)..(271): a, c, t, g, unknown or other
  modified_base (285)..(285): a, c, t, g, unknown or other
  modified_base (330)..(330): a, c, t, g, unknown or other
  modified_base (405)..(405): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctctggaagtactaccagttccactacttanaccatcaactggtncgccagcccctggacaggctgagtggatgggtgaatcattccttnttttgctccactcacctacgcaacgagtccgttccggggacaagtaacttacgacttaccgcggaacaagtccanagacacagtctcatgacatgatttcttagaaactccgaacgacaccggtcctactactactgtcgcgagcggtcccttacccagctcgcttagttggacgtccgttagcgtagtcggagggggtcgaacgggtaacccg

SEQ ID NO: 372836 - DNA, 566 bp, Homo sapiens
  misc_feature: GZ8MTXP01BUMYM.44.74.G08.1.454.CMB.2.raw
  modified_base (272)..(272): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaacgtactaccagttccactacttanaccatcaactgggtcgcgccacggcccctggacaagggcttgagtggatgggtgaatcattcccttcttttggctccgactcacctacgcaacgagccgttccggggacagaacttacgacgttaccgacgtacaagtccacagacacagtctaccatcgacatgatttcgttagaactccgacgacgaccggccgtctacgtacgtgtacgcgagtcggtcccgttacccagcgtcgcacgttcggacgtccgtttaggaacgtacgtcggttcggggcgaacgggtaacccg

SEQ ID NO: 372837 - DNA, 706 bp, Homo sapiens
  misc_feature: GZ8MTXP01AMQ6W.44.74.G08.1.454.CMB.2.raw
  modified_base (277)..(277): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttcctgcacggcctcgtggaacgtactacctagttccactacttanaccatcaacgtggtcgccgccgacggccccgtggaccgaagggcttgagtggagtgggtaggaactcgtacttcccgtttcgttttcggcttccccacctcaacccgttaccgcgtaaacgacgtccgttccggggacaagtaacttaccgacttaccgacgaacaacgtccaacagaaccacgaagtcctaccatagaaaccaattacgtacgtttaccgtttaagaaacgttccggaaacgtaaccgtaccgggtccgtacttaaccgtacgttgggtaccgtacggacgggtaaaccgggttccccgaaaccccgtacggttcccgttaccggaccgttaggttcgggttaaccgttcccgttttaggaaccggttacggttaccggggttcggggggtaaccgttaacccgggggttaaccccgg

SEQ ID NO: 372838 - DNA, 691 bp, Homo sapiens
  misc_feature: GZ8MTXP01BF8HJ.44.74.G08.1.454.CMB.2.raw
  modified_base (235)..(235): a, c, t, g, unknown or other
  modified_base (287)..(287): a, c, t, g, unknown or other
tcagacagtatatacacgaccggtgctcgatttagtagctctatcaggggggagcatcacataacaaccacattcctcctctaaagaagcccccgggagcacagctcatcaccatggactggacctggaggttcctctttgtggtggcagcagcaacaggtgtccagtccctggtgcaactggtgcagtctgggactagatgccgcaaccgttggtcctcggtcgtaccctttcngcacggcctcgtggaagtacctaccagttccactactatacatcactgggtnccgccgacggcccctggacgaaggggtcttggaggtggagtggggtaggaactcgtacttcccgttcgtttttcggcctctacccctcctaaccgtacgccgtaccggtaacgtacccggtttcccgggggactaaacgggtaaacttaccggtacgttacccggacgggtaacaaacggtccaacgacgacactagtcctaccatcgaactaagttcgtaacgtttacttaaggaaacttcccggaaccgaccgtaaccggccgttaccttaacgttacgtcggttacgaccggtacgtaccggggtcccctaccccgaggtcccttcggacgtagttccgggcgttcccgtttaaggacgtcggttacgggcgggggacgtaacggggttaaccccgttggg

SEQ ID NO: 372839 - DNA, 725 bp, Homo sapiens
  misc_feature: GZ8MTXP01EZ8A1.44.74.G08.1.454.CMB.2.raw
  modified_base (282)..(282): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatcgccgactaaccttcggtcctcggtcgtaccccttttctgccacggcctcgtggaacgtacctactagttccactacttanaccatcaacgtgggtcgccgcccgtacgggcccccgtagggaaccgtaacgggtcgttggaggtaggagttgggggtagaaacttccgactttccccgtttcgtttttcggccttcccgtaccttaccgaacccgttacgcccaaaccgggacggtaacccggtttcccgggggactaaacggtaacgttaaccggtacgttaacccggacggggtaactaaacgtcccaacgaacgaccacgtacgtcctaccatagactaagttgaacgtttcttaagaaacgtcccgaaacgaccgaaccggtcccgttctaacgttacgtcggttacgcgggtaacggccgggttaccccgttaacccgacggttcctaccgcttaggttcggttacgttccgttaggaacgtacgtcgggttcgggggaaccttaacggggtaacccg

SEQ ID NO: 372840 - DNA, 679 bp, Homo sapiens
  misc_feature: GZ8MTXP01A6PVQ.44.74.G08.1.454.CMB.2.raw
  modified_base (273)..(273): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttctgcacggtcctcgtaggaatactacagttccactactanaccatcaacgtgggtgccgccacggcccctggacaggcttgagtggagtgggtagaatcacttcccttgtttgctccgacctcgacctacgcaacgacgtccgtccggggactagtaacgttacgacttaccggacgtaactaacgtacccgaacacgtaaccacgtacggttacctacccgaataccgaactaaacgtacggttaacgttttacggtttaacggaaaacgtttccccggaaaccggtaacccgaccgggtccccgttacctaaccttaccgtggttaccggacggtacggtaaccgggttccccgttaccccgaggccctaccggcgttacggttcggacgttcccgtttggaaggtccgttcggggcgggggtaaccgaaccggggttaacccg

SEQ ID NO: 372841 - DNA, 636 bp, Homo sapiens
  misc_feature: GZ8MTXP01BNNZV.44.74.G08.1.454.CMB.2.raw
  modified_base (238)..(238): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagaatgccgctaaccgttggcagtcggtcgtacccctttcngccacggcctgtaggaaacgtacctaccacgttaccacttactactaccatacaacgtgggtcgccgaccgacggccccgtagggaccaagggtcgtggaggtggagtggggtagactctacttccttcgttttcgcctctactcacctacgacacgcgacgttccggggactagtaattacgacgttaccgacgtaacacgtccaacgacgacaacgacgtcctccagtacgaactaattcgtacggtttcttaagaaactccggaacgtaccgaccggtcccttaactaccgtacgtgtcggcggaacggtccggttccccgtacccgaggtccgtccgcgttagttcggtaacgtccgtttgacggtacgttcgggtcgggggaacgtaaccggg

SEQ ID NO: 372842 - DNA, 602 bp, Homo sapiens
  misc_feature: GZ8MTXP01A0PF6.44.74.G08.1.454.CMB.2.raw
  modified_base (268)..(268): a, c, t, g, unknown or other
  modified_base (502)..(502): a, c, t, g, unknown or other
  modified_base (549)..(549): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgctaaccttggtcctcggtcgaccctttctgcacgcctctggaatctaccagttccactactanaccatcaactggtcgccgaccgacggccccctggacgtaagggtcttaggagtggagtgggggtagaatccgtacttcccctttgtttttcggctcccacctcacccgtacgccaacgacggtaaccgttccggggacaagtaacttacgagttaccgacgaacacgtaccaacacgacacacgtcctaccatagactaaagtcgtagtttacttagaaacgtccgaccgtacnccggtctctactacgtgcgcgagcggtcccgttacccgacgctcgcncgttcggttacgtccgttagaacgtactgggttcggggcgaacgggtaacccg

SEQ ID NO: 372843 - DNA, 833 bp, Homo sapiens
  misc_feature: GZ8MTXP01CB239.44.74.G08.1.454.CMB.2.raw
  modified_base (245)..(245): a, c, t, g, unknown or other
  modified_base (271)..(271): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccctttcctgcacggcctntggaatactaccagttccactactanaccatcaactggtgcgccacggcccctggacaagggcttggaggtggagtggggtaggtaactcgtacttccccgttactttttcggccttacccgtaccttcgaacccgttaccggacccgaaaccgggtaacgtaaccggtttcccgggggactaaacgggtaaactttaaccggtaacgtttaaccccgggaccgggtaaacccgtaaacggttacccccgaaacgaacggaaacccaaacgtaaaccggtttacccttacccgaagttcggtaaaaccctaaggttaacgttaaccgggtttttttaaccttttaaacggaaaaaccgtttacccccgggaaaaccggtaaccggtaaccccggggttacccccggtttaacttaacccgttaaccgttcgggttacggaccggaaacggtaacccggggttacccccggttacccccgaacggttccccgttcggccgttaaacggttcgggttaccgttcccgttttagggaaagttcggtttccggggacggggggtaacccgttaacgggggttaaacccccgg

SEQ ID NO: 372844 - DNA, 533 bp, Homo sapiens
  misc_feature: GZ8MTXP01ATZUJ.44.74.G08.1.454.CMB.2.raw
  modified_base (235)..(235): a, c, t, g, unknown or other
  modified_base (286)..(286): a, c, t, g, unknown or other
  modified_base (355)..(355): a, c, t, g, unknown or other
  modified_base (495)..(495): a, c, t, g, unknown or other
  modified_base (499)..(499): a, c, t, g, unknown or other
  modified_base (512)..(512): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccctttccngcacggcctctggaagtactacagttccactacttataccatcaactggtncgccaggcccctggacaaggcttgagtgatgggtgaatcatcctcttttgctcactcactacgcacganaactcggggacagaacttagattacgcggacaagtcaacagacaacagtactccatagacaaatagtagttactttagtaaagtaccgacgaacacgccgtctactactagtgcgagaagtccggttacccacgccgtcncagngcgtcttgtaagngtggcgggcggaacggtaacg

SEQ ID NO: 372845 - DNA, 558 bp, Homo sapiens
  misc_feature: GZ8MTXP01AC7UL.44.74.G08.1.454.CMB.2.raw
  modified_base (270)..(270): a, c, t, g, unknown or other
  modified_base (335)..(335): a, c, t, g, unknown or other
  modified_base (375)..(375): a, c, t, g, unknown or other
  modified_base (471)..(471): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccagttccactacttanaccatcaacgtggtgcgccacggcccctggacaaggcttgagtggatgggtgaatcattcccttnttttggctccactcactacgcaacgagtccgttccggggnagtaattacgattaccgcggacaagtccacagacacagtctccatgacaatgtattcgtttagaaactccgaacgtacacggtcctctactactgngtcgaggtaacgtcccgttacccgagccgtacgcaggttcggacgtccttggaacgtacgtcggttgggggcaacgggggtaacccg

SEQ ID NO: 372846 - DNA, 656 bp, Homo sapiens
  misc_feature: GZ8MTXP01B7Y6I.44.74.G08.1.454.CMB.2.raw
  modified_base (273)..(273): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttcctgcacggcctctggaagtactacagttccactacttanaccatcaactgggtgcgccgacggcccctggacaagggcttggagtggagtgggtaggaatctacttcccttcttttggctccactcacctacgcaacgagccgttccggggacagtaacttacgacgttaccgacggacaacgtcccaacgacgaccacaacgttccaccatcgaactaagtgtaacgtttcgtttaagaaacttcccgaacgaaccgcccggtccgttacttaacctcgtggtacggaccggaacgggtaaccgggttccccgttaacccccgaggttcccgttaccggcgttaacgttcgggttaaccgtcccgttttaggaacggttacgtcggggttacggggggaaccttaaccgggggtaaccccg

SEQ ID NO: 372847 - DNA, 646 bp, Homo sapiens
  misc_feature: GZ8MTXP01EJEKE.44.74.G08.1.454.CMB.2.raw
  modified_base (239)..(239): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacgaggtgtccagtccctggtgcaactggtgcagtctgggactagaatgccgctaaccgttggtcctcggtcgtaccccttttcngcacggccctgtaggtaactactaccagttccactacttacaccatcaacgtggtcgccgccgacggcccccgtaggacgaacgggtcttgaggtggagtgggtagaatctacgttcccttgttttcgctccgactcactacgcaacgacgcgttccgggatacgtaattacgacttacgacggaactaacggtccaacacgaacacgacgtcctaccgatacgaaacctaattacggtacgttttacggttaacgtaaacctaccgaaccggaaacgtacccggcccgttacctaactacgtcggtcgaccggaaggtaacggtccccgaacccagccgtaccgtcaaggttcgggacctcgtttggaagtcgtccggacgggggtaaccgaacgggttaaccccg

SEQ ID NO: 372848 - DNA, 572 bp, Homo sapiens
  misc_feature: GZ8MTXP01BJQWD.44.74.G08.1.454.CMB.2.raw
  modified_base (273)..(273): a, c, t, g, unknown or other
  modified_base (516)..(516): a, c, t, g, unknown or other
  modified_base (535)..(535): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgtacccctttcctgcacggcctctggaagtactaccagttccactacttanaccatcaactggtgcgccaggcccctggacaagggcttggagtggatggggtggaatcgattccctcttttggctccactcacctacgcaacgagtaaccgttccggggacagtaacttacgattaccgcgggacaagtccacagacacagtctaccatgacaatgtagttcgttagtaaactccgacgtacaccggcccgtactactacgtgtcgcgagcggtcccgttaccccagctcgcncgttggacgtcctttgggngtacgtcgggttcgggggcgttaacggggtaaccccg

SEQ ID NO: 372849 - DNA, 595 bp, Homo sapiens
  misc_feature: GZ8MTXP01A4LUB.44.74.G08.1.454.CMB.2.raw
  modified_base (223)..(223): a, c, t, g, unknown or other
  modified_base (243)..(243): a, c, t, g, unknown or other
  modified_base (271)..(271): a, c, t, g, unknown or other
  modified_base (340)..(340): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtntaccctttctgcacggcctntggaagtactaccagttccactacttanaccatcaacgtggtcgcgccacggcccctggacaaggtcttgagtggagtgggtaggaatcattccttntttgctccactcacctcgcaacgagtcgttccggggacaagtaacttacgattaccgacgacaacgtccacagacacacgtctacatgactaatgtacgtttcgtttagaaacgttccgaacggacaccggtccgttactacgtactggtcgacggaaggtaaccggtcccgttaaccccagccgtcggacttacgttggacgtccgtttagaacggtacgtcgggttagggggaaccttaacgggggtaacccg

SEQ ID NO: 372850 - DNA, 567 bp, Homo sapiens
  misc_feature: GZ8MTXP01ERRSB.44.74.G08.1.454.CMB.2.raw
  modified_base (334)..(334): a, c, t, g, unknown or other
  modified_base (544)..(544): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgtaccctttctgcacggcctctggaagtactacagttccactactataccatcaactgggtgcgccacggcccctggacaaggcttgagtggagtgggtggaatcatccctntttggctccactcacctacgcaacgagcgttccggggcagaattacgattaccgacggtacaagtccacagacacagtctaccatgacaagtgacgttacgtttagaaattccgacgtacgaccggtccgtactactacctgtcgcgtagaacggttcccgttaccccgagttccgtcgcagttcggacgtcccttagaacgtagtcggnggggggtccaacggggtaacccg

SEQ ID NO: 372851 - DNA, 565 bp, Homo sapiens
  misc_feature: GZ8MTXP01EONE4.44.74.G08.1.454.CMB.2.raw
  modified_base (273)..(273): a, c, t, g, unknown or other
  modified_base (334)..(334): a, c, t, g, unknown or other
  modified_base (352)..(352): a, c, t, g, unknown or other
  modified_base (496)..(496): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttcctgcacggcctctggaagtactaccagttccactacttanaccatcaactgggtgcgccaggcccctggacaagggcttgagtggatgggtgatcatcctntttggctccactcactcncaacgagcttcggggcagattacgattaccgcggacaagtccacagacacagtctccatgacaatcgagtttcgttagtaaacttccgaacgtacaccggtccgtactacttactggtgccggaggaacggtcccgttaacccncgccgtcgcaagttcgggacgtccctttaggaaccgtagtccggttgggggtccgaacggggtaacccg

SEQ ID NO: 372852 - DNA, 682 bp, Homo sapiens
  misc_feature: GZ8MTXP01BV5WR.44.74.G08.1.454.CMB.2.raw
  modified_base (236)..(236): a, c, t, g, unknown or other
  modified_base (247)..(247): a, c, t, g, unknown or other
  modified_base (276)..(276): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagaatgccgcaaccttggtcctcggtcgtaccctttccngcacggtcctntgggaacttactacagttccactacttanaccatcaagtcggtgcgccaggcccctaggacgaagggcttgaggtggagtggggtagaactcgtacttcccgtttgttttcgcttccactcaccgtacgctaacgagtccgttcgggactaacgaagttacgaacgttaccggacgtacaaacgtcccaagtacgaaccactacggtcctaactagtacaaactacttagtaacgtttcggtttaagaaaccgttacccggaacgtacccgtacggtcccgttacttaaacctacggtgttacgaccggttagtaacccgggttccttaaacccccggtgttacccgtaccgacgttaccggttcggttaccgttaaccgtttaggtaacggtcggttccggggttacgggggtaaccgttaacggggtaacccg

SEQ ID NO: 372853 - DNA, 660 bp, Homo sapiens
  misc_feature: GZ8MTXP01BUYMW.44.74.G08.1.454.CMB.2.raw
  modified_base (454)..(454): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgctaaccgttggtcctcggtcgtacccctttcctgcacggcctcgtaggaacgttacctacctacgttccacttacttactaccatccaaacgtgggtgccgccgacggcccctaggacgaacggcgttgaggtaggagtcggggtagtaactctacttcccttcgttttcggctccgtacctctaccctacgcaacgacgtcgttccgggactagtaacttacgacgttaccgacgaacagtacccanacgacacacgtctaccatacgacaagttgtacgtttacgttaacgaaacgtccgaaacgaccgacccggtcgttactaaccgttacgtgtacggacgtacggaacggtaccccgttacccgacgttccgttacgccgttaggttcgggacgttccgtttaggaacgtacgttcgggacgggggtaaccgttaacggggttaacccg

SEQ ID NO: 372854 - DNA, 601 bp, Homo sapiens
  misc_feature: GZ8MTXP01C3QF4.44.74.G08.1.454.CMB.2.raw
  modified_base (239)..(239): a, c, t, g, unknown or other
  modified_base (272)..(272): a, c, t, g, unknown or other
  modified_base (423)..(423): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtcgtgggactagaatcgccgacaaccgttggtcctcggtcgacccctttcngcacggctgtaggatactacagtccactactanaccatcaacgtgggtcgcgccgacggccccgtggacgaaggcttgagtggagtgggtgaatcacttccttcgtttgcctcactcacctacgcaacgacgtccgttccggggacaagtaaacttacgacgttaccgacggaacaagtccaanagaccacagtcctccgatcgaacattgtagtttacttagaaacgttccgaacgacgaccggtccgtctaacgtcgttggcgcggacggaaccggttccccgaaccctgcctcgcttaagttcggacgttccgttaggaagtacgtcggggttacgggggaaccgaacggggtaacccg

SEQ ID NO: 372855 - DNA, 541 bp, Homo sapiens
  misc_feature: GZ8MTXP01DWANS.44.74.G08.1.454.CMB.2.raw
  modified_base (270)..(270): a, c, t, g, unknown or other
  modified_base (329)..(329): a, c, t, g, unknown or other
  modified_base (472)..(472): a, c, t, g, unknown or other
  modified_base (488)..(488): a, c, t, g, unknown or other
  modified_base (495)..(495): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttctgcacggcctctggaagtacaccagttccactacttanaccatcaactggtgcgccaggcccctggacaggctgagtggagtggtgaatcattcctntttgctcactcacctcgcaacgagcgttccggggcagaattacgattaccgcggacagtaccacagacactagtctccatgactaagtgtacgtttctttagaaacttccgaacgacgaccggtccgtctacgtactgtgcgngaacgtccgttacccngcgtcgnagttggacgtcctttgcgtagtcggttggggtcaacgggtaacccg

SEQ ID NO: 372856 - DNA, 706 bp, Homo sapiens
  misc_feature: GZ8MTXP01BV7HI.44.74.G08.1.454.CMB.2.raw
  modified_base (233)..(233): a, c, t, g, unknown or other
  modified_base (272)..(272): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgctaaccttggtcctggtctacccttcngcacggcctcgtaggaacgtactacagtccactacttanaccatctaacgtgggtcgcgccgacggcccctaggacgaagggtcttgagtggagtggggtaggaactcgactttcccctttcgttttcggcctaccctacctaccgaaccgtaccgccgaaaccggtacgtcccgggttccggggactaaacggtaacgttaccggtacgttacccgggacgtaacgtaaccgtaccaacgacgaacctacgtaacgttcctaccagtacgaaccaagttcgtaacgttttcgtttaaacgaaaccgttcccggaaaccgtaccgtcccggtaccgttactaaccgtcgtggtcgacggtacgggtaaccccggttacccgacccccgagttcccgtcggtacacggttcgggacttccgttaggaacgttacggtcggggttacgggggaacttaacccggggtttaaccgg

SEQ ID NO: 372857 - DNA, 593 bp, Homo sapiens
  misc_feature: GZ8MTXP01BBGMW.44.74.G08.1.454.CMB.2.raw
  modified_base (141)..(141): a, c, t, g, unknown or other
  modified_base (184)..(184): a, c, t, g, unknown or other
  modified_base (222)..(222): a, c, t, g, unknown or other
  modified_base (255)..(255): a, c, t, g, unknown or other
  modified_base (268)..(268): a, c, t, g, unknown or other
  modified_base (418)..(418): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgnggtggcagcagcaacaggtgtccagtccctggtgcaactggtncagtctgggactagatgccgcaaccttggtcctcggtntacccctttctgcacggcctctggaatactacngttccactactanacatcactgggtcgcgccacggcccctggacgaaggcttggagtggagtgggtgaatcattcccttgttttcggctccactcaccgtacgcaaacgacgtccgtcggggacaagtacttacgacgttaccgacgacagtccagacgacanacgtcaccatagactaagtgtacgtttacgttagaaacgtccgaacgtaccgaaccggtccgttctaaaccgttcgtgtacgccgtaacggaaccggttcccgttacccgagttccgtacgcgttagttcggagtccgttagcgtagtcggttacggggcttaacgggtaacccg

SEQ ID NO: 372858 - DNA, 674 bp, Homo sapiens
  misc_feature: GZ8MTXP01BPE5M.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatcgccgactaaccgttggtcctcggtcgtacccctttctgccacggtcctcgtaggaactactacctagttccacttacttacacccatccaacgtgggtcgccgccgacggccccctaggacgaacgggtctttggaggtggagttgggggtagaactcgtacttccctttgttttcgcctcccactcacctacgcaaaccgacgtccggttccggggactaagtaacttacgacgttacccggacggaaccaaagtcccaacgaacgaccaacgtaacgttcctaccaagtacgaactaagttagttacgtttaccgttaagaaaccgtcccgacgaaccgaccgggtcccttactaactcgtggtacgcgacggtaaccggttcccttacccgagttccgtacggcttacggttcggacttccgtttaggaacgtcgtcggggttacgggggtcgttaacggggtaacccg

SEQ ID NO: 372859 - DNA, 786 bp, Homo sapiens
  misc_feature: GZ8MTXP01D2E35.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgtaccctttctgcacggcctctaggaagtactaccagttccactacttataccatcaacgtggtgccgccgacggccccgtaggacgaagggtcttggaggtaggagttgggggtaggtaaatcgtacttcccctttagtttttcggccttcccaccttcaacccgttacgacccgaaaccggtacgtaaccggttacccggggactaaacggtaaacgtttaaccggtaacgtttaacccgggaccgggtaaacctaaacggttaccccaaacgaacggaaccctaaccctaacggttcccttaacccgaagttacggaaacctaaagttacgggttaacgtttttacgtttaacggtaaaaccgtttaccccgggaaccggtaaccgtacccggggtccccgttacttaaccgttaacgttcggtacgtacgggtaacgggtaaccgggttccccgttaaccccgtcgttaccgttcggacttacggttcgggttaacgttcccgttttaggaacgttacggtccgggttacgggggtaaccgttaacggggttaaccccgg

SEQ ID NO: 372860 - DNA, 577 bp, Homo sapiens
  misc_feature: GZ8MTXP01BBEJH.44.74.G08.1.454.CMB.2.raw
  modified_base (194)..(194): a, c, t, g, unknown or other
  modified_base (293)..(293): a, c, t, g, unknown or other
  modified_base (309)..(309): a, c, t, g, unknown or other
  modified_base (323)..(323): a, c, t, g, unknown or other
  modified_base (371)..(371): a, c, t, g, unknown or other
  modified_base (397)..(397): a, c, t, g, unknown or other
  modified_base (409)..(409): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccaggggaaanagccaccctctcctgcagggccagtcagagtgttgaccaaaaactcttagtctggttccagcagaaacctggccagactccaggctctcatctatggtncatccagcagggcctntggcagtcccgganaggttcaggtggcaggtgggtctggggacagaacttcaactctcaccntcagcagactggagctagaaacgttnttagctaggttntacttacgtgtacgagcgtaagttatcgtaccttactcctaccttgtacgtacggttaccggaccgtaacgggaccgtaagggtaacggaaactacggaaacgtacggtcggttacggttcttcggaacctacctaacgttcgtacgttccttaacgttcgtttcccc

SEQ ID NO: 372861 - DNA, 628 bp, Homo sapiens
  misc_feature: GZ8MTXP01EAM86.44.74.G08.1.454.CMB.2.raw
  modified_base (574)..(574): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgcaaccttggtcctcggtcgtaccctttctgcacggctctaggaacttactactacgttcactactataccatcaacgtggtgccgccacggcccctggacgaggtcttggagtggagtgggtagaatctacttccctttgttttacggccttacccgactaccgaccctacgaccaaaccggtacgtccggttcccggggactaaacgtaaacgttacgtaacgttacccggacgggaaactaacggtacccaacgacgtaacacgtacgtcctaccatacgaactaatgtacttacgtttagaactaccgaacacgtaccgtcgttacacgtctgtacgcgaggtaacgtcccgaccctagcgtcgnagttcggacttcgttagaacgtcgtcgggttcgggggaaccgaacgggtaaccg

SEQ ID NO: 372862 - DNA, 682 bp, Homo sapiens
  misc_feature: GZ8MTXP01D59JO.44.74.G08.1.454.CMB.2.raw
  modified_base (247)..(247): a, c, t, g, unknown or other
  modified_base (278)..(278): a, c, t, g, unknown or other
  modified_base (356)..(356): a, c, t, g, unknown or other
  modified_base (482)..(482): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagaatgccgctaaccttggtcctcggtcgtaccctttcctgcacggcctntaggaactactacctacgttccactacttanaccatcaacgtgggtcgcgccgacggcccctaggacgaagggtcttggagtggagttgggtaggaatcacttcccttnttttcggctccctactcacctacgacgaacgagtaaccggttccggggactaaggtaaactttaccgacgtttaacccggcgggaaacctaacgtaccaacgagaaccagtacgtcctacaagtanaactaagttcgttaacgtttacggttaacgaaaccgtaccgaaccgtaccgaccggtccgttacttaaccgttacgtaggtacggacggtaacgggtaacccggttaccccgttacccgtagttccgtccgacttaggttcggttacgttccggttaggaacgtacggtcggggacggggtaaccgttaacggggtaacc

SEQ ID NO: 372863 - DNA, 705 bp, Homo sapiens
  misc_feature: GZ8MTXP01AUVF8.44.74.G08.1.454.CMB.2.raw
  modified_base (300)..(300): a, c, t, g, unknown or other
  modified_base (675)..(675): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgctccgaggggaaagacgcccaccctctcctgcagggccagtcagagtgttagacctaaaactcttagtctggttccagcagaaaccgtggaccagacctccaggcctctcatctatggtncatcccagcgacggggccctcgtcggccacgttcccggaacgtacggttacaggttcgggacgtaggggtcggggttacgacgggggtaacacggttaacccttacaaccgttctacccgaaccctacgtacgaacgctaacgggtaccgttaggaacgtacccgttaggtaaacgttaagtttttcggactttaaggttaggtaaactttaccgtggttacaacggtaccggttaagttaacgttcgttacctttacgtaccctaaccgttcgttaccggtacgggttaccggacccgtaaacgggggtaccgtaaaagggtaccggaaaattcccggaaaacgtacggtgacgggttcttacgaacctacgtntacgtcgtttacctcgttaacgtttccccg

SEQ ID NO: 372864 - DNA, 631 bp, Homo sapiens
  misc_feature: GZ8MTXP01DQHL2.44.74.G08.1.454.CMB.2.raw
  modified_base (237)..(237): a, c, t, g, unknown or other
  modified_base (350)..(350): a, c, t, g, unknown or other
  modified_base (417)..(417): a, c, t, g, unknown or other
  modified_base (568)..(568): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccccttttccngcacgggtcctctaggaacgtacctacctagttccactacttataccatcaactgggtgccgccgaggcccctggacaaggcttggagtggatgggtagaatcattccccttnttttggcctcacctcactacgcaacgagtcgtcgggacagaattacgattaccgacgacaagtccanacgacacgatacctccaatcgaactaatggtactttacgtttaagaaacgttcccgaaacgacgtaaccgggtcccgttacttaaccgtacctgggtacgacggaacggtaaccgggttccccgttaaccccgaggttcccgttaccgganaacggtttggaacgttccgtttaggaagtacgtcgggttacgggggtcaacggggtaaccccg

SEQ ID NO: 372865 - DNA, 772 bp, Homo sapiens
  misc_feature: GZ8MTXP01B99OL.44.74.G08.1.454.CMB.2.raw
  modified_base (280)..(280): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgctaaccttggtcctcggtcgtacccctttcctgccacgggcctcgtggaagtacctacctagttccactacttanacctatcaacgtgggtcgccgccgacggtcccccgtaggaccgaacggggtcttggaggtgggtaggtgggggtagggaactcgtactttccccgtttcgttttttcggccttccccgtacctctacccgtacgacccaacggacgtccgttcccggggactagtaaacgttacgacgttacccgacggtaaccaagtacccgaacacggaaccacgtaacggtcctaccgaattcgaaactaagtaggttaacgttttacgtttaacggaaaccgtacccgggtaacccgaaccggtccccggggttacccttaccgttaaacgtttaccggtcgggttacggtaccggggaacggtaacccgggggttcccccgttaccccggagttcccggttacccgacggttaacggttcggggttaccgtttccgtttagggaacggttacggtccggggttacggggggcccgttaaccgggggttaaccccggg

SEQ ID NO: 372866 - DNA, 673 bp, Homo sapiens
  misc_feature: GZ8MTXP01C1WTN.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtcgtgggactagaatcgccgactaaccgtttggtcctcggtcgtacccctttcgtgccgacggtcctcgtaggaacgttacctacctacgttccactacttacaccatctaacgtgggtcgccgccgacggtcccccgtaggacgtaacgggtcttaggaggtaggagtgggggtagtaactcgtacttccctttcgttttcgcctccacctcacctacgcgaaacgacgtccggttacgggctaagtaacgtacgacgttaccggacgaactaacgtccaacgtacacactacgtccactagtacgaactaatgttacgtttacttaagaactaccgaacgacgaccggtcctacttacgtacgtggtacgacgacggtaacccggttaccccgaaccccgtacgccgttacgcgttaggttcggttacgttccgtttaggcgttacggtcggggacggggtaaccgttaaccggggtaacccg

SEQ ID NO: 372867 - DNA, 602 bp, Homo sapiens
  misc_feature: GZ8MTXP01AYIFE.44.74.G08.1.454.CMB.2.raw
  modified_base (271)..(271): a, c, t, g, unknown or other
  modified_base (316)..(316): a, c, t, g, unknown or other
  modified_base (343)..(343): a, c, t, g, unknown or other
  modified_base (430)..(430): a, c, t, g, unknown or other
  modified_base (511)..(511): a, c, t, g, unknown or other
  modified_base (533)..(533): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagatgccgcacttggtcctcggtcgaccctttctgcacggcctcgtggaagtacctaccacgttccactacttanaccatcaactgggtcgccgccgaggcccctggacgaaggcttggngtggagtgggtagaatcacttcccttnttttggctccactcacctacgcaacgacgccgttccgggacagtaacttacgacttaccgacggaacaacgtcccaacgacgaccanacgtccttccaatacgactaattgtacgtttgttagaaactcccgaaacgacaccggtccgtactactacgtcgtcgcggngtaacggtccccgttacccganccgtcgcgttgttggaccggtcctttggaaccgtaggtccgggttgggggaaccaacgggggtaacccg

SEQ ID NO: 372868 - DNA, 746 bp, Homo sapiens
  misc_feature: GZ8MTXP01BGVUI.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtcgtgggactagaatcgccgactaaccgtttggtcctcggtcgtacccctttcgtgccgacggtcctcgtaggaacgttacctacctacgttcccaacttacttactaccatccaacgtgggtcgccgcccgacggcccctaggacgaaggtcttaggaggtggacgtggggtagaacttcgtacgttcccgtttcgtttttcggaccttaccccgtacctaccgtaacccgttaccgacccgtaaaccgggtaaccggtaacccgggtttacccgggggaactaaacggtaaacccgtttaaccggaaccgtttaacccgggacgggtaaactaacggtacccaacgtacgaacctacgtacgtacctaccagtacgaactaagtcgttaacgtttcgttaacgaaaccgtccgaaacgtacgccggtaccttctaaaccgtcgtggtacggccgtaacggtccggtccccgttacccgagttccgtacgacgttaggttcggttaccgttcgttggaacgtacggtcgggacgggggtaacttaacggggtaaccg

SEQ ID NO: 372869 - DNA, 621 bp, Homo sapiens
  misc_feature: GZ8MTXP01BLZMV.44.74.G08.1.454.CMB.2.raw
  modified_base (245)..(245): a, c, t, g, unknown or other
  modified_base (276)..(276): a, c, t, g, unknown or other
  modified_base (291)..(291): a, c, t, g, unknown or other
  modified_base (435)..(435): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttctgcacggcctntggaacgtacctacctagttccactacttanaccatcaactgggtnccgccacggcccctggacgaaggtcttggaggtggagtggggtagaactctacttccctttcgttttcggctccactcacctacgcaaacgacgtccgttccggggactaagtaactacgtacttaccgacggacaacgtccanacgacagacgttcacatcgaactagtgtagtttcgttagaaacgtccgtacgaccgaccgggcccttactacctacgtcgtcggcgaggtaaccggtccccgttacccgagccgttaccgcttacggttggacgttcccgttagaacgtacgtcgggttagggggtcccaacgggggttaaccccg

SEQ ID NO: 372870 - DNA, 621 bp, Homo sapiens
  misc_feature: GZ8MTXP01B48RF.44.74.G08.1.454.CMB.2.raw
  modified_base (235)..(235): a, c, t, g, unknown or other
  modified_base (553)..(553): a, c, t, g, unknown or other
  modified_base (564)..(564): a, c, t, g, unknown or other
tcagacagtatatacacgaccggtgctcgatttagtagctctatcaggggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccctttcngcacggcctcgtggaatacctactagttccacttacttacaccatcaacgtggtcgccgccgacggcccctaggacgaagggtcttggagtggagtgggtagaatcacttcccttgttttcgctccgactacaccgtacgccaacgacgtccgttccggggataaggtaaacttaccggaacttacccggacggaacctacgtccaacagaccatacgtctaccatacgaactaatgtacgtttacgttaagaacgtcccgaacgtaccaccggtctactacgtcgtgtcgacgaggtaaccggtcccgttaacccgngttccgtacgngttacgttcggttacttcgtaggaacgtggtcgggacggggtaacgaacgggtaacc

SEQ ID NO: 372871 - DNA, 628 bp, Homo sapiens
  misc_feature: GZ8MTXP01DVN8V.44.74.G08.1.454.CMB.2.raw
  modified_base (279)..(279): a, c, t, g, unknown or other
  modified_base (539)..(539): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttcctgcaccggcctcgtaggaacgttactaccagttccactacttanaccatcaactgggtcgcgccacggcccctaggacaagggcttggagtggagtggggtgaatcgtacttccccttcgttttggcctccacctacacctaccgcaaccgagtccgttccggggctaagtaacttacgacgttaccggacgacaacgtccaacgagaccaacacgttcctaccagtacgaacaatagtacgtttcgtttaagaaacttcccggaacgaccgaccggtccgttactaactacgttgtcgacggngaaccggttcccttaccccgagccgtcgcttaagttcggacgtccgtttagaagtacgtcgggttacggggtccaacgggggtaacccg

SEQ ID NO: 372872 - DNA, 822 bp, Homo sapiens
  misc_feature: GZ8MTXP01C4V9O.44.74.G08.1.454.CMB.2.raw
  modified_base (236)..(236): a, c, t, g, unknown or other
tcagacagtatatacacgaccggtgctcgattttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttcngcacgggtcctgtaggaacgtacctacctagttcccacttacttataaccatacaaacgtgggtacgccgcccgaggccccctaggacgaaggggtcttaggacggtgggagttgggggtaggtaaactccgtacttcccctttacgttttttcggggaccttccccgtacctccgtaacccgttaaccggacccgtaaaccgggtaacgtaacccgggtttcccgggggaaaccaaacgggttaaactttaccgggaactttaaccccggaccgggtaaactaacggtacccaacgaacgtaccgaaccgtagttacccttccaagtggaaacctaaattcggggtaactttttacggttttaaacgaaaccgtttcccggaaccggtaaccgtaacccgggtcccgtttacttaacccgtaacgttcggtacggaccggtaacggtaaccccgggttccccgttaccccggtaaacggcccgttaaccggcttaaacgggttcgggttaaacccgttcccgtttacgggaagggttaccgttcggggttacggggggaacccgttaaccgggggttaaccccgg

SEQ ID NO: 372873 - DNA, 662 bp, Homo sapiens
  misc_feature: GZ8MTXP01A2BRS.44.74.G08.1.454.CMB.2.raw
  modified_base (237)..(237): a, c, t, g, unknown or other
  modified_base (303)..(303): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgctaaccgttggtcctcggtcgtacccctttcngccacggtcctcgtaggaacgtacctacctacgttccacttacttacaccatactaacgtgggtcncgccgacggccccctaggacgaaggtcttaggaggtggtagtgggtaggaactcctacttcccgttgttttcgctcccactcgacctacgcaacgacgtccgttccggggactaacgtaacttacgacgttaccggacgacaacgtccaacgacgaccacgtacgtctaccatacgaacaagtgttaacggtttcttaaggaaacgtccgacgtaccgaccggtcctactactcgtggtcgaccggtaggtaacccggtccccgttacccgaggccctacggcgttaacggttcgggacccgttcgttagggaacgttcgggtccgggttacggggggtcccgaacgggggtaacccgg

SEQ ID NO: 372874 - DNA, 595 bp, Homo sapiens
  misc_feature: GZ8MTXP01EZHQU.44.74.G08.1.454.CMB.2.raw
  modified_base (230)..(230): a, c, t, g, unknown or other
  modified_base (239)..(239): a, c, t, g, unknown or other
  modified_base (263)..(263): a, c, t, g, unknown or other
  modified_base (527)..(527): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaacttgtcctcggtgaccctttcngccacgctntggaatactacatccactacttanacatcaacgtggtacgcgccgacgccccgtggacgaaggcttggagttggatgggtagagtcacttccttcgtttggctccactcacctacgcaacgagtccgttccgggactaacgtaacttacgacttacggacgaacaacgtccacgacgacacgtacgtcctaccagtagactaagtgtagtttcgttaacggaaatacccgaacgaccgtaccggtccgtactaacgtctgtcgacgacgaaccgtcccgttaaacccncgttacgcgtcacgttggacgttccgttagcgtacggttcgggacgggggtccgaacggggtaacccg

SEQ ID NO: 372875 - DNA, 775 bp, Homo sapiens
  misc_feature: GZ8MTXP01DN3RQ.44.74.G08.1.454.CMB.2.raw
  modified_base (276)..(276): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagaatgccgcaaccttggtcctcggtcgtaccctttcctgcacggcctcgtaggaagtactaccagttccactacttanaccatcaactgggtcgcgccacggcccctggacgaagggcttggagtggagtggggtaggtaatcgtacttcccctttcgtttttcggccttccccaccgttcctaacccgttacccgaccgaaaccgtaacgggtaacccgtttcccggggggacctaaacgggtaaactttaaccgggtaacgtttaaccccgggaccgggtaaaccgaaaggttcccccaaaccgaaggaacccaacgaacgttcctacccaattacggaaactaaagtgttacgttttcgtttaaacgaaacttcccggaaaccgtaccgaccggtacccgttcttaaaccgttacgttgggttaccgacgggtaacggtaaccgggttcccccgttaccccgaacggcccgtttaccggccgttaacggttcgggttaaacggtccccgtttttagggaaggttccggtacggggttcggggggtaacccgttaacggggggtttaacccccgg

SEQ ID NO: 372876 - DNA, 811 bp, Homo sapiens
  misc_feature: GZ8MTXP01CDVBB.44.74.G08.1.454.CMB.2.raw
  modified_base (207)..(207): a, c, t, g, unknown or other
  modified_base (239)..(239): a, c, t, g, unknown or other
  modified_base (281)..(281): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagaatcgccnctaaccgttggtcctcggtcgtacccctttcngcacggtcctcgtggaactactaccgtagttccactacttanaccatcaacgtgggtcgcgccgacggccccgtggacgaagggtcttggagtggagtgggtaggaatcgtacttcccgtttacgtttttcggccttccctaccttcgaacccgttaccgaccgtaaacccgggtacgtcccgggttccgggggaacctaaagggttaaacgtttaccggtaacggtttacccgggacccgggtaaaccaaacggttaccccaaacgacggtaaccaaccgtaacggttccctaaccgtaacgttacggaaaccgtaagtttacgggtaacgttttttccgtttaaaggaaaaccgttccccggtaaaccggtacccggtaacccgggtaccccgtttaacttaaccggttaccgtcgggttaccgggaccggtaccgggtaacccggttccccggttaacccccgtaggccccgttaacggccttaaagggttccgggttaccggttccgttttggaacggttaccgggtccgggttacggggggtaacccgttaaccggggttaacccgg

SEQ ID NO: 372877 - DNA, 799 bp, Homo sapiens
  misc_feature: GZ8MTXP01DLV8E.44.74.G08.1.454.CMB.2.raw
  modified_base (241)..(241): a, c, t, g, unknown or other
tcagacagtatatacacgaccggtgctcgatttagtagctctatcagggggagcatcacataacaaccatattcctcctctaaagaagcccctgggagcacagctcatcaccatggactggacctggaggttcctctttgtggtggcagcagcaacaggtgtccagtccctggtgcaacgtggtgcagtcgtgggactagaatcgccgactaaccgttggtcctcggtcgtaccctttccngccacggtcctgtaggaactacctacctagttcctactacttacaccatactaacgtgggtcgccgcccgacggccccgtaggaacgaagggtcttggacggtggagtgggtagaactctacttccctttgttttcggccttaccccacctacctaacccgtacgaccgtaaaccgtacgtcccggttcccggggactaaacggtaaacgttaaccgtaacgttacccgggacggaaaccgtaacggtacccaacgaacgaacctaacgtacggttcctaaccgtaagtacgaaactaagttacgttaacggttttacgtttaaacgtaaaaccgttccccggaaaccgtaaccgtaccccgggttaccttaacccgttaaaccgttacgtacggtcggaaccgggtaaacgggtaaccccgggtttaaccccgaacccccgtaggcccgttacccgggacttacggttacggggttaacccgtttcccggttttaggaacggttccgggttcgggggttaccggggggtaacccggttaaaccgggggttaaccccg

SEQ ID NO: 372878 - DNA, 599 bp, Homo sapiens
  misc_feature: GZ8MTXP01B2CVU.44.74.G08.1.454.CMB.2.raw
  modified_base (135)..(135): a, c, t, g, unknown or other
  modified_base (183)..(183): a, c, t, g, unknown or other
  modified_base (234)..(234): a, c, t, g, unknown or other
  modified_base (281)..(281): a, c, t, g, unknown or other
  modified_base (297)..(297): a, c, t, g, unknown or other
  modified_base (349)..(349): a, c, t, g, unknown or other
  modified_base (412)..(412): a, c, t, g, unknown or other
  modified_base (418)..(418): a, c, t, g, unknown or other
  modified_base (489)..(489): a, c, t, g, unknown or other
  modified_base (514)..(514): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggagttcctntttgtggtggcagcagcaacaggtgtccagtccctggtgcaactggtncagtctgggactagaatgccgcaacctttggtcctcggtgaccccttttcngcacgggccttcgtgggaaacttacctacctagttcccactacttanaccatcaacgtgggtncgccacggcccctggacaaggcttgagtggatgggtagaatctattcccttnttttggcctcactcacctcgcaacgagtcgtcgggcagtactacgattaccgagacagtccanagacanagtcctcatcgaactatcgtagtttcgttagaaactccgacgactacggccgtatactactggtacgacgnggtaaccggtccccgttaaaccccncggttccgtacgacgttacgttcggttacgttccgttaggaacgtcggtacgggttacgggggtaaccgttaaccggggtaaccg

SEQ ID NO: 372879 - DNA, 700 bp, Homo sapiens
  misc_feature: GZ8MTXP01ADYA6.44.74.G08.1.454.CMB.2.raw
  modified_base (127)..(127): a, c, t, g, unknown or other
  modified_base (151)..(151): a, c, t, g, unknown or other
  modified_base (263)..(263): a, c, t, g, unknown or other
  modified_base (322)..(322): a, c, t, g, unknown or other
tcagacagtatatacacgaccggtgctcgatttagtagctctatcagggggagacttcccttcctatgataagagaggcctggaggttcctccttagctgtgggctcagaagcagagttctggggtntctccaccatggcctggacccctntctggctcactctcctcactctttgcatagggtctgtagtttcttctggctgactcaggatctgctgtgtctgtggccttgggacagacagtcaagatcacatgccacgganacacgcctcagaggcactatgacaagctaggaccaacgagaacgccggacacggccctntacgtgccatggttaacgtaaaaccgcccggacccgttaccgggctacccgagaccgtatttcctcgtacggtccctaccctaccgtacgaacgggaaaacctcgacgtacccgtttaccgttacgaaccctaactcccgtaaacgttcggggaaccttacggggaacggggtaccggtaaagaaccgttaggaacgggtccttacggtaaaccttagtttaacgttcgaccgttaaacggctaaacgggttccccgggaaacttacgggttaaacgttaacgttaggttaccctttaaggtttccggttttacccgaacccggtaaaaccccgggtaccgttaacgggttaaccccgttaaccggttttaaccccgg

SEQ ID NO: 372880 - DNA, 534 bp, Homo sapiens
  misc_feature: GZ8MTXP02I2VHC.44.74.G08.1.454.CMB.2.raw
  modified_base (359)..(359): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccaggcccctggacaagggcttgagtggatggatggaatcatcctcttttggcctcactcacctacgcacgngacttcggggcagaattacgattaccgcgacaacgtccaacagacacacgtctccatgacaatgagttcttagaaatccgacgacacggccgtctacgtactgtgcgagcggtaccgtacccagcctcgaccatggaacgtcctttagacgtatcgtacgggggactaaccgggg

SEQ ID NO: 372881 - DNA, 524 bp, Homo sapiens
  misc_feature: GZ8MTXP02G3R9K.44.74.G08.1.454.CMB.2.raw
  modified_base (333)..(333): a, c, t, g, unknown or other
  modified_base (402)..(402): a, c, t, g, unknown or other
  modified_base (429)..(429): a, c, t, g, unknown or other
tcagacagtatatacacgaccggtgctcgatttagtagctctatcaggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccaggcccctggacaagggcttgagtggatgggtggaatcatccctntttttggctccactcacctacgcacgagcgttccggggcagaattacgattaccgcggacaagtcccanagacacagtctccatgacaatgagttntttagaaatccgagacacggcctctacactgtgcgagacggtccctacccagctcgcactggacgcctttgagtatcgtggggccaggtaacccg

SEQ ID NO: 372882 - DNA, 522 bp, Homo sapiens
  misc_feature: GZ8MTXP02JZJFF.44.74.G08.1.454.CMB.2.raw
tcagacagtatatacacgaccggtgctcgatttagtagctctatcaggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccaggcccctggacaagggcttgagtggatgggtggaatcatccctcttttggctcactcacctacgcacgagcttccggggcagaattacgatttaccgcgacaagtccacagacacagtctccatgacaatgagttctttagaatccgacgacacgccgtctactactgtgcgagacggtccgtaccccagctcgcactggagcctttgacgatcgtgggggctagggaacccg

SEQ ID NO: 372883 - DNA, 695 bp, Homo sapiens
  misc_feature: GZ8MTXP02JB7GI.44.74.G08.1.454.CMB.2.raw
  modified_base (273)..(273): a, c, t, g, unknown or other
  modified_base (406)..(406): a, c, t, g, unknown or other
tcagacagtatatacacgaccggtgctcgatttagtagctctatcaggggagcatcacataacaaccacattcctcctctaagaagcccctcgggagcacagctcatcaccatggactggacctggaggttcctctttgtggtggcagcagcaacaggtgtccagtccctggtgcaactggtgcagtctgggactagaatgccgcaaccttggtcctcgtgaccctttcctgcacggcctctggaagtactaccagttccactactataccancaactgggtgcgccacggcccctggagaagggcttgagtggagtgggttgggaaatcacttccccttcgtttttggtctccccactccctacctaaccggtcaaccgaggtaccggtttcccggggcggtaanaaatttaaccgaacgtttaccccggaccgggaaccgaaacgtacccaccgaagaccgaacctacgtacctccctacgtagtacaaactaggttcgtttaaccgttttagtaaaacacccgtacggaacctacccgggccgttaccgtacttaccgtacgtggtacggacgtaaaccggggtacccggttacccccaaccgggccttacggtacccacgttgggaaccggttccgtttacggtaggttaacggtacggtccgggggttacgggaacggggtaaacccccg

SEQ ID NO: 372884 - DNA, 542 bp, Homo sapiens
  misc_feature: GZ8MTXP02JTOJU.44.74.G08.1.454.CMB.2.raw
  modified_base (334)..(334): a, c, t, g, unknown or other
  modified_base (409)..(409): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtgatcatcccttnttttggctccactcacctacgcacgagccgttccggggcagtaattacgattaccgcgacaagtccacagacacngtcctccatgacaatgattcttagaaatccgacgacacgccgtactactactgtgcgagtacggtcccgtacccacgcctcgcagtcggagtccgttaggagtacgtcggtacgggggacacggggtaacccg

SEQ ID NO: 372885 - DNA, 513 bp, Homo sapiens
  misc_feature: GZ8MTXP02ITTYI.44.74.G08.1.454.CMB.2.raw
  modified_base (328)..(328): a, c, t, g, unknown or other
  modified_base (348)..(348): a, c, t, g, unknown or other
  modified_base (490)..(490): a, c, t, g, unknown or other
tcagacagtatatacacgaccggtgctcgatttagtagctctatcaggggagcatcacataacaaccacattcctcctctaaagaagcccctgggagcacagctcatcaccatggactggacctggaggttcctctttgtggtgacagcagcaacaggtgtccagtccctggtgcaactggtgcagtctgggactagaatgccgcaaccttggtcctcggtgaccccttttcctgcacggcctctggaagtactaccagttccactacttataccatcaactggtgcgccagcccctggacaaggcttgagtgatggtgatcatcctnttttggctcactcacctacncacgagcttccggggcagaattacgattaccgcgacaagtccacagacacagtctcatgacaatgagttcttagaaatccgacgacaacgccgtctactactgtgcgagacggtccgtacccagctcgcatgagcctttganacgtcgtcggggcacggtaaccg

SEQ ID NO: 372886 - DNA, 525 bp, Homo sapiens
  misc_feature: GZ8MTXP02HA5VM.44.74.G08.1.454.CMB.2.raw
  modified_base (285)..(285): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtncgccaggcccctggacaagggcttgagtggatgggtgaatcatcctcttttggctccactcacctacgcacgagcttccggggcagattacgattaccgcgacagtcccacagacacagtctccatgacaatgagttcttagaaatccgacgacacggcctctactactgtgcgagacggtcccgtacccagctcgcagtggagccgtttgacgacgtcgtcgggggcacggggtacccg

SEQ ID NO: 372887 - DNA, 500 bp, Homo sapiens
  misc_feature: GZ8MTXP02F5Z6R.44.74.G08.1.454.CMB.2.raw
  modified_base (194)..(194): a, c, t, g, unknown or other
  modified_base (310)..(310): a, c, t, g, unknown or other
  modified_base (323)..(323): a, c, t, g, unknown or other
  modified_base (379)..(379): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccaggggaaanagccaccctctcctgcagggccagtcagagtgttgaccaaaactcttagtctggttccagcagaaacctggccagactcccaggctcctcatctatggtgcatccagcagggcctntggcatcccgganaggttcagtgcagtgggtctgggacagacttcactctcaccatcagcagactgganctagagatttgctagtgtattactgtcagcagtatgtcttactcacctctgtacgttcggaccaagggaccaaggtaggaaatacaaacgactagacgctgcaccatctgtactcacttcc

SEQ ID NO: 372888 - DNA, 563 bp, Homo sapiens
  misc_feature: GZ8MTXP02I95FC.44.74.G08.1.454.CMB.2.raw
  modified_base (283)..(283): a, c, t, g, unknown or other
  modified_base (333)..(333): a, c, t, g, unknown or other
  modified_base (372)..(372): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactacagttccactactataccatcaactggtncgccaggcccctggacaagggcttgagtggagtgggtggaatcatccctnttttggctccactcacctacgcacgagccgttccggggnaagaattacgattaccgcggacaagtccacagacacagtctccatgacaatgagttcttagaaatccgacgacacgccgtactactactgtagcgaagtacggtaccccgtaccccacgtcctcggacctaagttcggaacgtcccgtttaggagtaacgtccggtagggggaccaacggggtaaaccccg

SEQ ID NO: 372889 - DNA, 540 bp, Homo sapiens
  misc_feature: GZ8MTXP02H8MKA.44.74.G08.1.454.CMB.2.raw
  modified_base (286)..(286): a, c, t, g, unknown or other
  modified_base (330)..(330): a, c, t, g, unknown or other
  modified_base (353)..(353): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtncgccaggcccctggacaaggcttgagtggatggtgatcatcctntttgctcactcactacgcacgancgttccggggcagaattacgattaccgcgacagtccacagacacagtctccatcgacaatgagtttcttagaaacttccgacgacacggccgtactactctgtgcgacgacgtcccgtacccacgtcctacgccagtcggacgtccgtttaggacgtactcggtacgggggctaacggggtaacccg

SEQ ID NO: 372890 - DNA, 536 bp, Homo sapiens
  misc_feature: GZ8MTXP02JX7V4.44.74.G08.1.454.CMB.2.raw
tcagacagtatatacacgaccggtgctcgatttagtagctctatcaggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccaggcccctggacaagggcttgagtggatgggtggaatcatccctcttttggctccactcacctacgcacgagcttccggggcagaattacgattaccgcggacaagtccacagacacagtctccatgacaatgagttctttgaaatccgacgacacggccgtctactactgtcgcgagacggtcccgtaccccaggcctcgccagtcggagtccgtttgacgtacgtcgtcgggggcacgggtacccg

SEQ ID NO: 372891 - DNA, 511 bp, Homo sapiens
  misc_feature: GZ8MTXP02I383K.44.74.G08.1.454.CMB.2.raw
  modified_base (194)..(194): a, c, t, g, unknown or other
  modified_base (204)..(204): a, c, t, g, unknown or other
  modified_base (308)..(308): a, c, t, g, unknown or other
  modified_base (321)..(321): a, c, t, g, unknown or other
  modified_base (354)..(354): a, c, t, g, unknown or other
  modified_base (358)..(358): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccaggggaaanagccaccctntcctgcagggccagtcagagtgttgccaaaactcttagtctggttccagcagaaacctggccagactccaggctcctcatctatggtgcatccagcagggcctntggcatcccgganaggttcagtggcagtgggctgggacagacttcnctcncaccatcagcagactggagcctgaagtatttgctagtgtattactgtcagcagtatgcttactcactctgtacgttcggacagggaccaaagggtcgaaaatcgaaaacgaactgtacggcttacgcgaacctatcctgtcttacactttccc

SEQ ID NO: 372892 - DNA, 526 bp, Homo sapiens
  misc_feature: GZ8MTXP02G0II9.44.74.G08.1.454.CMB.2.raw
  modified_base (285)..(285): a, c, t, g, unknown or other
  modified_base (333)..(333): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtactaccagttccactactataccatcaactggtncgccaggcccctggacaagggcttgagtggatgggtgaatcatccctnttttggctccactcacctacgcacgagctccggggcagatacgattaccgcgacaagtccacagacacagtctccatgacaatgagttctttagaaatccgacgtacacggccgtactactactgtgcgagacggttcccgtacccagctcgacagtggagtcctttgagtatcgtggggacagggtaacccg

SEQ ID NO: 372893 - DNA, 525 bp, Homo sapiens
  misc_feature: GZ8MTXP02GULMH.44.74.G08.1.454.CMB.2.raw
  modified_base (286)..(286): a, c, t, g, unknown or other
  modified_base (333)..(333): a, c, t, g, unknown or other
  modified_base (493)..(493): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtncgccaggcccctggacaagggcttgagtggatgggtgatcatccctnttttggctcactcacctacgcacgagcttccggggcagaattacgattaccgcggacaagtccacagacacagtctcatgacaatgagttctttagaaatccgacgacacggccgtctactactgtgcgagacggtcccgtacccagcctcgccatgganccgtttgacgctcgtcgggggcaggggtaccc

SEQ ID NO: 372894 - DNA, 514 bp, Homo sapiens
  misc_feature: GZ8MTXP02JD33S.44.74.G08.1.454.CMB.2.raw
  modified_base (193)..(193): a, c, t, g, unknown or other
  modified_base (281)..(281): a, c, t, g, unknown or other
  modified_base (291)..(291): a, c, t, g, unknown or other
  modified_base (322)..(322): a, c, t, g, unknown or other
  modified_base (355)..(355): a, c, t, g, unknown or other
  modified_base (421)..(421): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccaggggaanagccacctctcctgcagggccagtcagagtgttgaccaaaactcttagtctggttccagcagaaacctggccagactccaggctcctnatctatggtncatccagcagggcctcgtggcactcccgganggttcagtggcaggtgggtctgggacagacttnctctcaccatcagcagactgagctagagtatttgcagtgtattactgtcagtcagtatgctttacnctaccttctgtacgttcggaccgaagggaccaagggtaggaaactacgaaaacgacgtagtcgactgaacacctactctgtcttcacttcccg

SEQ ID NO: 372895 - DNA, 516 bp, Homo sapiens
  misc_feature: GZ8MTXP02F2AZ0.44.74.G08.1.454.CMB.2.raw
  modified_base (334)..(334): a, c, t, g, unknown or other
  modified_base (444)..(444): a, c, t, g, unknown or other
  modified_base (485)..(485): a, c, t, g, unknown or other
tcagacagtatatacacgaccggtgctcgatttagtagctctatcaggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccaggcccctggacaagggcttgagtggatgggtggaatcgatccctnttttggctccactcactacgcacgagcttccggggcagaattacgattaccgcggacagtccacagacacagtctcatgacatgattcttgaatccgacgacacgccgtntactactgtgcgagtacggtccgtacccagctcgcatgganccgtttgagactcgtggggcagggtaacccg

SEQ ID NO: 372896 - DNA, 521 bp, Homo sapiens
  misc_feature: GZ8MTXP02F7PYK.44.74.G08.1.454.CMB.2.raw
  modified_base (232)..(232): a, c, t, g, unknown or other
  modified_base (332)..(332): a, c, t, g, unknown or other
  modified_base (358)..(358): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcatcggtgaccctttcngcacggcctctggaagtactaccagttccactacttataccatcaactggtgcgccaggcccctggacaagggcttgagtggatgggtgaatcatccctnttttggcctcactcacctacgcacgngacttccgggggcagattacgattaccgcgacaagtccacagacacagtctccatagacaaatgagttcttgaaactccgacgaccacggccgtctactactgtgcgagacggtccgtacccagctcgacatggaagcctttgagatcgtgggggcaacgggg

SEQ ID NO: 372897 - DNA, 529 bp, Homo sapiens
  misc_feature: GZ8MTXP02FV1XE.44.74.G08.1.454.CMB.2.raw
  modified_base (194)..(194): a, c, t, g, unknown or other
  modified_base (283)..(283): a, c, t, g, unknown or other
  modified_base (323)..(323): a, c, t, g, unknown or other
  modified_base (360)..(360): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccaggggaaanagccaccctctcctgcagggccagtcagagtgttgaccaaaactcttagtctggttccagcagaacctggccagactcccaggctcctnatctatggtgcatccagcagggccctgtggcatcccgganaggttcagtggcaggtgggtctggggacagaccttcnctctcaccatcagcagactggagccgtagaagtattttgctagtgtattactgttacagctagtatgtacttactccactctgtacgttcggaccgaacgggacctaaggtacggaaatacgaaaacgaacgtgtacggctagaacacgactctgtctactacttcccg

SEQ ID NO: 372898 - DNA, 533 bp, Homo sapiens
  misc_feature: GZ8MTXP02JZ8ME.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccaggcccctggacaagggcttgagtggatgggtggaatcatccctcttttggctccactcacctacgcacgagcttccggggcagattacgattaccgcggacaagtccacagacacagtctccatgacaatgagttcttgaaatccgacgacacgccgtactactactgtgcgagacggtcccgtacccacgctcgcacgtcggacgccgtttgacgtacgtcgtcgggggcacggggtacccg

SEQ ID NO: 372899 - DNA, 560 bp, Homo sapiens
  misc_feature: GZ8MTXP02J1QTV.44.74.G08.1.454.CMB.2.raw
  modified_base (329)..(329): a, c, t, g, unknown or other
  modified_base (408)..(408): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgccacggcctctggaagtactaccagttccactacttataccatcaactggtgcgccaggcccctgacaggctgagtggatggtggatcatccctntttttggctccactcacctacgcacgacgcgttccggggcagattacgattaccgcgacaacgtccacagacacagtcnccatgacaactgagtttctttagaaattcccgacgaccaacggcccgttctaccttacgtgtcgcgagtacggtacccgtaccccgacgcctcgctacgtcggacgtcccgtttaggacgtacgtcggtcgggggacgacgggtaaccccgg

SEQ ID NO: 372900 - DNA, 545 bp, Homo sapiens
  misc_feature: GZ8MTXP02FVI1K.44.74.G08.1.454.CMB.2.raw
  modified_base (333)..(333): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtactaccagttccactacttataccatcaactggtgcgccagcccctggacaagggcttgagtggagtggtggatcatccctnttttggctcactcactacgcacgagcgttccggggcagaattacgataccgcggacaagtccacagacacagtcctaccatacgacaagtagtagttctttagaaatcccgaacgacaccgggctactactacgtagtgcgagacggtcccgtacccacggctcgctacgtggagcctttgacgtacgtcgtcgggggacacgggtaacccg

SEQ ID NO: 372901 - DNA, 560 bp, Homo sapiens
  misc_feature: GZ8MTXP02HZ62A.44.74.G08.1.454.CMB.2.raw
  modified_base (327)..(327): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccaggggaaagagccaccctctcctgcagggccagtcagagtgttgaccaaaactcttagtctggttccagcagaaacctggaccagactcccaggcctcctcatctatggtgcatccagcagggcctgtggccagtcccgganagggttcaggtggcaggtgggtctaggggactaggaccttcacgttcacacccgattccgagccagacgtgagcctagaagtattttgctagttgtattactgtacgagtactagttatgtacttactctacctcgtcgtacgtcggtacgaaacgggtaaccaaggtacggaaactacgaaacgtaaacgtcgtacgactacgaacgactactactcgtacttctacttccg

SEQ ID NO: 372902 - DNA, 510 bp, Homo sapiens
  misc_feature: GZ8MTXP02IU3T4.44.74.G08.1.454.CMB.2.raw
  modified_base (194)..(194): a, c, t, g, unknown or other
  modified_base (203)..(203): a, c, t, g, unknown or other
  modified_base (294)..(294): a, c, t, g, unknown or other
  modified_base (310)..(310): a, c, t, g, unknown or other
  modified_base (324)..(324): a, c, t, g, unknown or other
  modified_base (359)..(359): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccaggggaaangccaccctntcctgcagggccagtcagagtgttgaccaaaaactcttagtctggttccagcagaaacctggccagactcccaggctcctcatctatggtncatccagcagggcctntggcagtcccgganaggttcagtggcagtgggtctggggacagacttcnctctcaccatccagcagactggagcctgaagtattttgctagtgtattactgtacagcagtatgtcttactctacctctgacgttcggacgagggaccaaggtaggaaatcaaaacgactgtacggctagcacatctagtcttcacttccg

SEQ ID NO: 372903 - DNA, 665 bp, Homo sapiens
  misc_feature: GZ8MTXP02GGR7R.44.74.G08.1.454.CMB.2.raw
  modified_base (338)..(338): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctctggaagtactaccagttccactacttataccatcaactggtgcgccaggcccctggacaagggcttggagtggagtgggtggaatctactcctnttttggctccactcacctacgcacgagtaccgttccggggacaagtaaattaccgacgtttacccggacgggaaacctaaacggtacccaacgaaacggaaccaaccgtaaacgtccctacccaagtacgaacctaaagttggtaagtttacttttaggaaaacttcccggaaacgaacccgtaaccgggtcccgttactaacttaaccgttgtacggacgtaacggtaccggtaccccgttaaccccgagtcccgtacggactaacggtcgggaacgtcccgtttagacgtacgttcggtacgggggacgaacggggttaaccccg

SEQ ID NO: 372904 - DNA, 563 bp, Homo sapiens
  misc_feature: GZ8MTXP02G9RJ5.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctcgtggaagtactaccagttccactacttataccatcaactggtgcgccaggcccctggacaaggcttgagtggatgggtggaatcatcccttctttttggctccactcacctacgcacgagccgttcggggcagtaattacgacttaccgcgacagtccacagacacagtcctaccatgacaatgtacgtttacttagaaactcccgagaccgaccggccgtactacgtactgtagcgaagtacgggtaccctaccccgagcctcggctaacgtcgggacgtccgtttagacgtagtcggtcggggacgacgggtaacccg

SEQ ID NO: 372905 - DNA, 520 bp, Homo sapiens
  misc_feature: GZ8MTXP02JPR91.44.74.G08.1.454.CMB.2.raw
  modified_base (299)..(299): a, c, t, g, unknown or other
  modified_base (372)..(372): a, c, t, g, unknown or other
tcagacagtatatacacgaccggtgctcgatttagtagctctatcagggggctggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatctcctgcactggaagcagcagtgacgttggtgcttataactttgtctcctgtatcaacaatatccaggcagacgccccaaatcatcatttangatgtcagtcatccggcctgagggtttccaatcgcttctctggctccaagtctggacaacgacggccctcccngaccatctcgtggctcgaggctgaggacgagctgtattacactgccagctacatatacaagcagcacacctacccttatcgtccttacggaacttcggggaacctaacgggtcccaaccggtccgtaacggtccacggccccaaacgg

SEQ ID NO: 372906 - DNA, 531 bp, Homo sapiens
  misc_feature: GZ8MTXP02JUHLO.44.74.G08.1.454.CMB.2.raw
  modified_base (211)..(211): a, c, t, g, unknown or other
  modified_base (276)..(276): a, c, t, g, unknown or other
  modified_base (302)..(302): a, c, t, g, unknown or other
  modified_base (324)..(324): a, c, t, g, unknown or other
  modified_base (443)..(443): a, c, t, g, unknown or other
  modified_base (460)..(460): a, c, t, g, unknown or other
tcagacagtatatacacgaccggtgctcgatttagtagctctatcagggggagacttcccttcctatgataagagaggcctggaggttcctccttagctgtgggctcagaagcagagttctggggtgtctccaccatggcctggacccctctctggctcactctcctcactctttgcatagggtctgtagtttctctgggctgactcaggngtctgctgtgtctgtggccttgggacagacagtcaagatcacatgccacggagacagcctcgagngggcacgtatgcaagctggtaccaanagaagccgggacacggcccctntactgccagtgtttacggaaaacgccggccgtacgggactccccagaccgatctcgtcgcctccacctacacgaaacacagtccttcctacgaccatcacgtggactcgaggacgaagngtagagctgactaattntcgcagcagtccggacaggtagtaactgtacttagtaacgtttcgacgaccggactacggtacaccgttcg

SEQ ID NO: 372907 - DNA, 533 bp, Homo sapiens
  misc_feature: GZ8MTXP02FXSWV.44.74.G08.1.454.CMB.2.raw
  modified_base (285)..(285): a, c, t, g, unknown or other
  modified_base (334)..(334): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtncgccaggcccctggacaagggcttgagtggatgggtggaatcatccctnttttggctccactcacctacgcacgagcttccggggcagaattacgattaccgcgacaagtccacagacacagtctccatgacaatcgagttcttagaaatccgacgacaccggccgtctactactgtgcgagacggtccgtaccccagcctcgccagtggacgccgtttgagtacgtcgtcggggacagggtaacccg

SEQ ID NO: 372908 - DNA, 542 bp, Homo sapiens
  misc_feature: GZ8MTXP02HS1L0.44.74.G08.1.454.CMB.2.raw
  modified_base (332)..(332): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagtccactactataccatcaactggtgcgccaggcccctggacaaggcttgagtggatgggtggaatcatcccttnttttggctccactcacctacgcacgagcttccggggcagaacttacgataccgcgacaagtccacacgacacagtctccatagacaatgagtttctttagaaatccgacgacaccggaccgtctactactgtcgcgagacggtacccgtaccccagctcgcacgtcggagtccgtttgacgtactcggtcgggggactaacgggtacccg

SEQ ID NO: 372909 - DNA, 544 bp, Homo sapiens
  misc_feature: GZ8MTXP02JKQH9.44.74.G08.1.454.CMB.2.raw
  modified_base (332)..(332): a, c, t, g, unknown or other
  modified_base (359)..(359): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactactataccatcaactggtgcgccaggcccctggacaaggcttgagtggatgggtggaatcatccctnttttggctccactcacctacgcacgancgttccggggcagattacgattaccgcgacaagtccacagacacagtctccatgacaatgagttctttagaaactccgacgacacggcccgtctactactgtagcgaggacggtcccgtacccacgccgtacgccaagttcggagtcccgttagacgacgtcgtacggggccacggggtaacccg

SEQ ID NO: 372910 - DNA, 590 bp, Homo sapiens
  misc_feature: GZ8MTXP02J1ZCG.44.74.G08.1.454.CMB.2.raw
  modified_base (282)..(282): a, c, t, g, unknown or other
  modified_base (355)..(355): a, c, t, g, unknown or other
  modified_base (366)..(366): a, c, t, g, unknown or other
  modified_base (381)..(381): a, c, t, g, unknown or other
  modified_base (388)..(388): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaatactaccagttccatactataccatcaactggtncgccaggcccctggacaagggcttgagtgatgggtggaatcatccctcttttggctccactcactacgcacgngtcgtccgggnagatacgatcgcganagtccanacgacacagtcctcagtcgaacaagtgtagtttactttagtaaacgtcccggacgtaccgaccggtaccgtactactaccgttgtcggacgtaacgggtaccggttacccgtaacccccgagtcccgttacgaccgtagtcggacgttccctttaggaacgtacgttcggttacgggggacctaacgggggttaaacccccg

SEQ ID NO: 372911 - DNA, 563 bp, Homo sapiens
  misc_feature: GZ8MTXP02F3ISO.44.74.G08.1.454.CMB.2.raw
  modified_base (338)..(338): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgtaccctttctgcacggcctctggaagtactaccagttccactacttataccatcaactggtgccgccacggcccctggacaagggcttggagtggagtgggtggaatcatccctnttttggctccactcactacgcacgagtcgtccggggcagaacttacgacgttaccgcggaacacgtccacagacacacgtctcatgacatgtattcttagaaactccgacgacaccggccgtctactactgtcgcgacgacggtcccgtacccacgcctacgccgtaagtcggtaacgtccgtttaggacgtacgtcgggtacggggaccgtacggggtaacccg

SEQ ID NO: 372912 - DNA, 519 bp, Homo sapiens
  misc_feature: GZ8MTXP02H4CRJ.44.74.G08.1.454.CMB.2.raw
  modified_base (232)..(232): a, c, t, g, unknown or other
  modified_base (331)..(331): a, c, t, g, unknown or other
  modified_base (353)..(353): a, c, t, g, unknown or other
tcagacagtatatacacgaccggtgctcgatttagtagctctatcaggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttccngcacggcctctggaagtactaccagttccactacttataccatcaactggtgcgccaggcccctggacaagggcttgagtggatgggtgatcatccctntttgctcactcactacgcacgngcttccggggcagaattacgattaccgcggacaagtccacagacacagtctcatgacaatgagttctttgaaatccgacgacacggccgtctactactgtgcgagacggtccgtaccccagctcgcactggacgtctttgagtactcgtgggggcacgggtacccg

SEQ ID NO: 372913 - DNA, 617 bp, Homo sapiens
  misc_feature: GZ8MTXP02JXCW7.44.74.G08.1.454.CMB.2.raw
  modified_base (383)..(383): a, c, t, g, unknown or other
  modified_base (556)..(556): a, c, t, g, unknown or other
tcagacagtatatacacgaccggtgctcgatttagtagctctatcagggggagcatcacataacaaccatattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctcgtggaatactaccagttccactacttataccatcaacgtggtcgcgccacggcccctggacaagggcttgaggtggagtgggtggaatcgacttcccttgttttggctccactcacctacgcacgagccgttccggggnacgtaattacgacttaccgcggactaacgtcccaacgacgaccaacgagttcctaccgaatcgaacctaaattacggtagttttaccttttacggaaaacttacccggaacggaccgaccggtccccgttacttaccgtacgttgtcgacggacgtacggtccccgtaccccnggacctcgacagtcggacgtccgtttggacgtacgtcggtcgggggtacacgggtaacccg

SEQ ID NO: 372914 - DNA, 528 bp, Homo sapiens
  misc_feature: GZ8MTXP02HZT5M.44.74.G08.1.454.CMB.2.raw
tcagacagtatatacacgaccggtgctcgatttagtagctctatcaggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccaggccccctggacaagggcttgagtggatgggtgatcatcctctttggctcactccactacgcacgagcgttccggggcagaacttacgattaccgcggacaacgtccacagacacagtcctcatgacatgtagttcttagaatcgacgacacgccgtctactactgtgcgagtacgtccgtacccagcctcgcagtcgacgtccgtttgagtacgtcgtcgggggactacgggtacccg

SEQ ID NO: 372915 - DNA, 532 bp, Homo sapiens
  misc_feature: GZ8MTXP02ICU7K.44.74.G08.1.454.CMB.2.raw
  modified_base (332)..(332): a, c, t, g, unknown or other
  modified_base (356)..(356): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtctaccagttccactacttataccatcaactggtgcgccaggcccctggacaagggcttgagtggatggatggaatcatcctnttttgcctcactcacctcgcacgngacttccggggcagattacgattaccgcgacaagtccacagacacagtctccatgacaaatgagttctttagaatccgacgacacggcctctactactgtgcgagacggtccctacccagcctcgacctagtgggaactccctttaggacgtatccggtagggggactaaccgggg

SEQ ID NO: 372916 - DNA, 538 bp, Homo sapiens
  misc_feature: GZ8MTXP02FWCC1.44.74.G08.1.454.CMB.2.raw
  modified_base (330)..(330): a, c, t, g, unknown or other
  modified_base (395)..(395): a, c, t, g, unknown or other
  modified_base (473)..(473): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccagttccactacttataccatcaactggtgcgccaggcccctggacaagggcttgagtggatgggtgatcatcctnttttggctccactcactacgcacgagcgtccggggcagaacttacgattaccgcggacagtccanagacacagtctcatgacatgattcttagaatccgagacacggccgtctactactgtcgcgagacggtcccgtaccccngacctcgccaagtcggaacgtccgtttaggacgtacgtccgtagggggacctacggggtaacccg

SEQ ID NO: 372917 - DNA, 598 bp, Homo sapiens
  misc_feature: GZ8MTXP02JCQYJ.44.74.G08.1.454.CMB.2.raw
  modified_base (224)..(224): a, c, t, g, unknown or other
  modified_base (233)..(233): a, c, t, g, unknown or other
  modified_base (271)..(271): a, c, t, g, unknown or other
  modified_base (285)..(285): a, c, t, g, unknown or other
  modified_base (329)..(329): a, c, t, g, unknown or other
tcagacagtatatacacgaccggtgctcgatttagtagctctatcgagggggagcatcacataacaaccacattcctcctctaaagaagcccctgggagcacagctcatcaccatggactggacctggaggttcctctttgtggtggcagcggcaacaggtgtccagtccctggtgcaactggtgcagtctgggactagaatgccgcaaccttggtcctcggtnaccctttcngcacggcctcgtggaagtactacagttccactacttanacatcaactggtancgccaggcccctggacagggcttgagtgatggtgatcatccctnttttgctcacctcacctacgcacaagactccggggcagattacgattaccgcgacaagtccacagacacagtactccatgtacaatgagttctttagaaacttccgaacgtaccgaacggtcccgtacttaacctactggttcgacgtacggtaccggtacccggttacccccgaagtccgttaccgacgtaacgtacgggaacgttcccgtttaaggaacgtacgtttccggtacgggggaccaacgggggttaaaccccctttcggg

SEQ ID NO: 372918 - DNA, 566 bp, Homo sapiens
  misc_feature: GZ8MTXP02IND3Z.44.74.G08.1.454.CMB.2.raw
  modified_base (282)..(282): a, c, t, g, unknown or other
  modified_base (352)..(352): a, c, t, g, unknown or other
  modified_base (379)..(379): a, c, t, g, unknown or other
  modified_base (421)..(421): a, c, t, g, unknown or other
  modified_base (425)..(425): a, c, t, g, unknown or other
  modified_base (497)..(497): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgcaaccttggtcctcggtcgtaccccttttcctgcaccggcctcgtggaacgtacctacccagttcccactacttanaccatcaactggtgcgccacggcccctggacaagggcttggagtggagtggggtaggaatcattcccttnttttggctccactcacctacgcacgancgttccgggcagaactcgataccgcgacagtccacagacacngtcncatgacatgtatttcttagaactccgacgacacggtcctactactactgtcgacgagtacggtcccgacccngcctacgcaacgttcggacgttccgtttagacgtacgttacggcgggggtaccgaacggggtaaacccg

SEQ ID NO: 372919 - DNA, 527 bp, Homo sapiens
  misc_feature: GZ8MTXP02HEU4G.44.74.G08.1.454.CMB.2.raw
  modified_base (284)..(284): a, c, t, g, unknown or other
  modified_base (333)..(333): a, c, t, g, unknown or other
  modified_base (409)..(409): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtctaccagttccactacttataccatcaactggtncgccaggcccctggacaagggcttgagtggatgggtggaatcatccctnttttggctccactcacctacgcacgagcgttccggggcagaattacgattaccgcgacagtccacagacacagtcncatgacatgattcttagaatccgacgtacacggcctactactactgtgtcgagtacggtccgacccacgctcgcgactcggacgcctttgacgtactcgtcggggacgacggtacccg

SEQ ID NO: 372920 - DNA, 615 bp, Homo sapiens
  misc_feature: GZ8MTXP02GRW3K.44.74.G08.1.454.CMB.2.raw
  modified_base (282)..(282): a, c, t, g, unknown or other
  modified_base (291)..(291): a, c, t, g, unknown or other
  modified_base (306)..(306): a, c, t, g, unknown or other
  modified_base (312)..(312): a, c, t, g, unknown or other
  modified_base (318)..(318): a, c, t, g, unknown or other
  modified_base (375)..(375): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccgaggggaaagagccatcctctcctgcagggccagtcagagtgttagaccaaaaatcttagtctggttccagcagaaacctggcagactccaggctcnatcatggtncatccagcaggcctntggcanccgganaggttcagtgccagtggtctggggacagcttcactctacacatcaagcagactggancgtagaaagttatttcgagtagttagtacttaaccgttgtaccgaaagtcctaagttatacggttcctttaaacccgtctaaaccccttcgttaaacggtccccggtttacgggaaacccgtaaacgggggaaaccctaagggggtaacggtaaaacttaaccggaaaaaccgtaccgtaggttacggacccttaaggacccaaaccggtaatcccgttagtacccttttactaaccccg

SEQ ID NO: 372921 - DNA, 656 bp, Homo sapiens
  misc_feature: GZ8MTXP02FVO3Q.44.74.G08.1.454.CMB.2.raw
  modified_base (324)..(324): a, c, t, g, unknown or other
tcagacagtatatacacgaccggtgctcgatttagtagctctatcagggggagacttcccttcctatgataagagaggcctggaggttcctccttagctgtgggctcagaagcagagttctggggtgtctccaccatggcctggacccctctctggctcactctcctcactctttgcatagggtctgtagtttcttctgggctgactcaggagtctgctgtgtctgtggccttgggacagacagtcaagatcacatgccacggagacagcctcagagggcactatgcaagctaggtaccaacagaagccgggacacggcccctntactgtccatgttagaaaacgccgcccgtccgggctcccagaccgtattctactcggcctcccacctacaacggaaaacacacgtccttcccttagaaccctataccaccgttaggggacctacgaacgggtaccggaaagacgtaggaacggtctaggtaacttagttaagtttacgacaacggtaccgtaacggttacccggggtaacgtaaaggttaaacgttaaagttacgtaccgtttttaagtttaaccgggttttttccggacccggtaaacccccgggggtaaccgtaaaaccggggttcccgtaaacccccggttttacccgg

SEQ ID NO: 372922 - DNA, 658 bp, Homo sapiens
  misc_feature: GZ8MTXP02H7QLY.44.74.G08.1.454.CMB.2.raw
  modified_base (398)..(398): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtcgtgggactagaatgccgcaaccgttggtcctcggtcgtaccctttctgcacggcctcgtggaactacctaccagttccactacttactaccatcaacgtgggtcgcgccgacggcccctaggacgaagggtcttaggaggtggagtggggtagaatcatccctttgttttggctccactccacctacgcacgacgtccgtccgggganaacgtaattacgacgtaccgcgaaccaacgtcccaacgacgaccactacgtctaccagtacgactaaagtgtaacgttttcttaagtaaacttccggaacgaaccgtaccggtacccgttacttaaccgtacgttcggtacggaccgtaacgggtaccggttacccccgtaaccccgagtcccgttacggaccgtaaggttcggaacgttccgtttaggaacgtacgttcggggacgggggacgtaaaccggggtacccg

SEQ ID NO: 372923 - DNA, 574 bp, Homo sapiens
  misc_feature: GZ8MTXP02IYBE2.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccacggcccctggacgaagggcttgagtggagtggggtagaatcactcccttgtttcggctccactcacctacgcacgagcgtccggggacagtaactacgacttaccgcgacaagtccacgaacgacacgacgtcctacatacgaactagtagtagtttactttagaaactccgaacgacgaccggtaccgttactactacgtgtcgcgacgtacggtcccgtacccgagtctcgcgtacgtcgggtcttaaggacgtacgcggtaggggacctacgggaccttgg

SEQ ID NO: 372924 - DNA, 547 bp, Homo sapiens
  misc_feature: GZ8MTXP02G9V7E.44.74.G08.1.454.CMB.2.raw
  modified_base (234)..(234): a, c, t, g, unknown or other
  modified_base (331)..(331): a, c, t, g, unknown or other
tcagacagtatatacacgaccggtgctcgatttagtagctctatcaggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccccttttccngcacggcctctggaagtctaccagttccactacttataccatcaactggtgcgccaggcccctggacaagggcttgagtggatgggtgatcatcctnttttggctccactcactacgcacgagcttcggggcagaattacgatacgcggacaagtccaacagacacagtctccatgacaagtgagttctttagaaactccgacgacacggccgtactactactgtgacgtagacgggtccctaacccgacgcctcggcaacgtcggaagtcccgtttaggactacgtcggtacggggcaacggggtaaccccg

SEQ ID NO: 372925 - DNA, 539 bp, Homo sapiens
  misc_feature: GZ8MTXP02HP3TZ.44.74.G08.1.454.CMB.2.raw
  modified_base (285)..(285): a, c, t, g, unknown or other
  modified_base (335)..(335): a, c, t, g, unknown or other
  modified_base (372)..(372): a, c, t, g, unknown or other
  modified_base (404)..(404): a, c, t, g, unknown or other
  modified_base (409)..(409): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccagttccactacttataccatcaactgggtncgccaggcccctggacaagggcttgagtggatgggtggaatcatcccttnttttggctccactcacctacgcacgagcttccggggnagattacgattaccgcgacagtccacagacanagtcnccatgacatgatttctttagaaatccgaacgacacggccgtctactactgtgcgagtacggtcccgtacccagcctcgcacgtcggacgtccgtttggacgtacgtcgtcgggggccacggggtaacccg

SEQ ID NO: 372926 - DNA, 634 bp, Homo sapiens
  misc_feature: GZ8MTXP02IHHG8.44.74.G08.1.454.CMB.2.raw
  modified_base (380)..(380): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccttttcctgcacggcctctggaacgtactaccagttccactacttataccatacaactggtgcgccacggcccctggacgaaggcttgagtggagtgggtgatcactcctctttttggctccactcacctacgcacgacgtcgttccggggnaagtaacttaccgacttaccgcggaactaacgtcccaacacgaaccaacagtcccttacaatacgaaacataggtagttttactttaggaaaacttccccggaacgaacctacccggggtacccgttacttaaccgttaactggtacgacggtaacggtacggtccccgtaccccgagttacccgacgccgtaagttcggaacggttccctttaggacgtacggtcggtacgggggacgacggggttaaccccg

SEQ ID NO: 372927 - DNA, 549 bp, Homo sapiens
  misc_feature: GZ8MTXP02IK0EA.44.74.G08.1.454.CMB.2.raw
  modified_base (285)..(285): a, c, t, g, unknown or other
  modified_base (393)..(393): a, c, t, g, unknown or other
  modified_base (402)..(402): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtncgccaggcccctggacaagggcttgagtggatgggtgatcatccctcttttggctccactcacctacgcacgagccgttccgggcagtaacttacgattaccgcgganacgtcccanagacacagtctaccatgacaatgagtttcttaggaaactccgaacgacaccggccgtctactactgtgcgagtacggtcccgtacccgacgctcgcgagttcggaagtccgttgacgtacgtcgtcgggggtacacggggtaacccg

SEQ ID NO: 372928 - DNA, 554 bp, Homo sapiens
  misc_feature: GZ8MTXP02JQMKL.44.74.G08.1.454.CMB.2.raw
  modified_base (332)..(332): a, c, t, g, unknown or other
  modified_base (414)..(414): a, c, t, g, unknown or other
  modified_base (429)..(429): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttctgcacggcctctggacgtactaccagttccactacttataccatcaactggtgcgccaggcccctggacaaggcttgagtggatgggtgaatcatcctnttttgctccactcacctacgcacgagccgttccggggacagaattacgactttaccgacggacagtcccacagacacagtcncatgacaatgagttntttagaatccgaacgtacacggtccgtactactactagtgacgaggacggtcccgtacccaccgacgtcgccgtacgtcggtagtcgttcgtagacggtcgtcgggggacgggtacgtaaccggg

SEQ ID NO: 372929 - DNA, 593 bp, Homo sapiens
  misc_feature: GZ8MTXP02GVPZB.44.74.G08.1.454.CMB.2.raw
  modified_base (342)..(342): a, c, t, g, unknown or other
  modified_base (362)..(362): a, c, t, g, unknown or other
  modified_base (381)..(381): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttcctgccacggcctcgtggaagtactaccagttccactacttataccatcaactggtcgcgccacggcccctggacgaaggcttgagtggagtgggtgaatcactcccttntttggctccactcacctacncacgacgccgttccggggnacgaattacgagttaccgcggacagtcccacacgacacagtcctacatgaactagtgtacgttactttagaaacttcccgaacgaccgaccggtccgtactactaccgtgtacgcgacggtaccggtacccgtacccacggtcctaccgacctaggtcgacgttcccgtttgacgttagtccggtacgggggaccgtaacggggtaaccccg

SEQ ID NO: 372930 - DNA, 566 bp, Homo sapiens
  misc_feature: GZ8MTXP02HFVU9.44.74.G08.1.454.CMB.2.raw
  modified_base (238)..(238): a, c, t, g, unknown or other
  modified_base (294)..(294): a, c, t, g, unknown or other
  modified_base (346)..(346): a, c, t, g, unknown or other
  modified_base (373)..(373): a, c, t, g, unknown or other
  modified_base (381)..(381): a, c, t, g, unknown or other
  modified_base (389)..(389): a, c, t, g, unknown or other
  modified_base (420)..(420): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagaatgccgcaaccttggtcctcggtcgtaccccttttccngccaccggcctcgtggaagtacctacagttccactacttataccatcaacgtggtncgccacggcccctggacaagggtcttgagtggagtgggtgaatcatcccttnttttggctccactcacctacgcacgancgtcgggnagatacgntacgcgacagtcacagacatagtctcaagtnaacatgtagtttcttacgaaatccgaacgaccgaccgtccgtactaactacgtgtcgacgacggacggtccccgtaaccacgtcctcgaccagtcggacgtcctttaggacgtacgtacggtcgggggaccgtaacgggtaacccg

SEQ ID NO: 372931 - DNA, 554 bp, Homo sapiens
  misc_feature: GZ8MTXP02GKQFD.44.74.G08.1.454.CMB.2.raw
  modified_base (232)..(232): a, c, t, g, unknown or other
  modified_base (336)..(336): a, c, t, g, unknown or other
  modified_base (361)..(361): a, c, t, g, unknown or other
  modified_base (371)..(371): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcngcacggctctggaagtactaccagttccactacttataccatcaactggtcgcgccacggcccctggacaagggcttggagtggagtgggtgaatcactccttntttggctccactcactacgcacgancgtccggganagattacgatccgacgacagtccacagacacagtctacatgactaatgtatttctttagaaactccgaacgtacgaccgtctacgtactacgtgtcgacgtacgacggtccctacccacgtcctcgacgtacgtggacgtccgtttagacgtacgtcgggtacggggacgtaacgggtacccg

SEQ ID NO: 372932 - DNA, 581 bp, Homo sapiens
  misc_feature: GZ8MTXP02GUND3.44.74.G08.1.454.CMB.2.raw
  modified_base (373)..(373): a, c, t, g, unknown or other
  modified_base (379)..(379): a, c, t, g, unknown or other
  modified_base (389)..(389): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccccttttcctgccaccggcctcgtaggaacgtactaccagttccactacttataccatcaacgtggtgcgccacggcccctggacgaaggcttgagtggagtggggtaggaatctactcccgttcttttggctccactcacctacncacgancgttccgggnagaatacgactaccgcgaacaacgtccacagacacagtcctacatgacaatgtatttctagtaaactccgaacgaccgaccggcctactactacgtgtcgacgacggtacggtacccgtaccccagtccctcgacgtacgttggactccgtttagacggtacgtcggtacgggggccaacggggtaaccccg

SEQ ID NO: 372933 - DNA, 585 bp, Homo sapiens
  misc_feature: GZ8MTXP02JX0JG.44.74.G08.1.454.CMB.2.raw
  modified_base (392)..(392): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccccttttcctgccacggcctcgtaggaaagtaactacccagttcccactacttataccatcaacgtgggtgcgccaggcccctggacaagggcttgagtggagtggggtggaatctatcccttcgtttttggctccactcacctacgcacgagccgtccgggganagattacgattaccgcggaacaagtccacagacacacgtctacatcgactaatgatttacttagaaacgtccgacgactaccggccgttctactacgtggtcgacgaacggtcggtacccgtacccacggcctcggctaacgtcggactccgtttaggaacgtcgtcgggtcgggggactacggggtaacccg

SEQ ID NO: 372934 - DNA, 568 bp, Homo sapiens
  misc_feature: GZ8MTXP02J0EZK.44.74.G08.1.454.CMB.2.raw
  modified_base (335)..(335): a, c, t, g, unknown or other
  modified_base (411)..(411): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctnttttggctcactcacctacgcacgagccgtccggggcagaattacgattaccgcggacagtccacagacacagtcnccatgacaatgagttcttagaaattccgaacgaccacggccgtactacctactgtgcgacgacggtcccgtaccccaggccctcggcaacgttcgggaacgtcccgttttaggacgtaacgttccggtacggggggaccaacgggggttaaaccccg

SEQ ID NO: 372935 - DNA, 585 bp, Homo sapiens
  misc_feature: GZ8MTXP02JOG95.44.74.G08.1.454.CMB.2.raw
  modified_base (372)..(372): a, c, t, g, unknown or other
  modified_base (404)..(404): a, c, t, g, unknown or other
tcagacagtatatacacgaccggtgctcgatttagtagctctatcaggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtctaccagttccactactataccatcaactggtgcgccaggcccctggacaagggctgagtggagtgggtagatcactccttcgtttcggctcctactcacctacgcacgacgtcgtccggggnagtaactacgactaccgcgaacaagtcccaanagacacgagtcctacatagacaactgatttcgttagaaactcccgagacgacggccgtactactacgtgtcgacgacggtaccggttaccccgtacccgaggtcccgtacgccgtaagttcggggaacttccgtttgaacggtacggtcggtacggggggaccgtaacgggggtaaccccg

SEQ ID NO: 372936 - DNA, 812 bp, Homo sapiens
  misc_feature: GZ8MTXP02G4PML.44.74.G08.1.454.CMB.2.raw
  modified_base (233)..(233): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcngcacggcctctggaagtactaccagttcccactacttataccatcaactggtgcgccacggcccctggacaagggcttgagtggagtggggtggaaactcgtaacttccccgttcgttttttcgggccttaccctaccttaccaacccgttaaccggccgtaaaccggaacggtacccggttttcccggggggacctaaacggtaaaacgtttaaccgggaaacgttttaaccccgggaccggggaaaccctaaaacgggttcccccaaacgtaaacgggaaacccaacccgtaacggttacccttacccaaacgttagggaaaccctaaaagtttcgggtaaacgtttttacccgttttaaggaaaaaccgtttccccggaaaccgggaacccgtaaccccgggggtacccgttaccttaaaccgtttaacgtcggttacgggaccgtaacgggtaaccggggttacccccgttaaacccccgaggtccccttaccggacgtaacggttcggggaactttcccggtttagaacggtacgttccggggtacgggggaccgtaacgggggttaacccccg

SEQ ID NO: 372937 - DNA, 568 bp, Homo sapiens
  misc_feature: GZ8MTXP02JA73V.44.74.G08.1.454.CMB.2.raw
  modified_base (286)..(286): a, c, t, g, unknown or other
  modified_base (338)..(338): a, c, t, g, unknown or other
  modified_base (366)..(366): a, c, t, g, unknown or other
  modified_base (409)..(409): a, c, t, g, unknown or other
  modified_base (415)..(415): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttcctgcacggcctctggaagtactaccagttccactactataccatcaactggtncgccacggcccctggacaagggcttgagtggagtgggtagaatcatcccttnttttggctccactcacctacgcacgacnccgttccgggacagtaacttacgattaccgcgaacaagtccanagacanacgtcaccatgaactaatggtatttcttagaaactccgaacgacacggccttactactacgtgtacgcgaaggtcggtacccgacccgagcctacgactaagtcggtactccgtttagacggtactcgggtcgggggacaacggggtaccccg

SEQ ID NO: 372938 - DNA, 587 bp, Homo sapiens
  misc_feature: GZ8MTXP02JQ99Q.44.74.G08.1.454.CMB.2.raw
  modified_base (451)..(451): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttcctgccacggcctctggaagtactaccagttccactacttactaccatcaacgtggtgccgccgacggcccctggacaagggcttggagtggagtggggtggaatcgacttcccttcgtttttggctccactcacctacgcacgagccgttccggggacaacggtaattacgacttacccggacggaactaacgtcccaacacgacacagtcctacatnaacatcgtagtttcttagaactccgacgacacgccgtactacgtctgtgcgacgtacggtccctacccgacgtcctcgcgaacgtcggacgtccgtttggacgtacgtcggtacgggggacgtaacgggtaacccg

SEQ ID NO: 372939 - DNA, 608 bp, Homo sapiens
  misc_feature: GZ8MTXP02IUYGO.44.74.G08.1.454.CMB.2.raw
  modified_base (301)..(301): a, c, t, g, unknown or other
  modified_base (321)..(321): a, c, t, g, unknown or other
  modified_base (339)..(339): a, c, t, g, unknown or other
  modified_base (462)..(462): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccgaggggaaagagccaccctctcctgcgagggccagtcagagtgttcgaaccaaaactacttagtctggttccagcaagaaacctggccagacctccaggcctcctcatctatggtncatccaggcagggccctcgnggccagtccccgggtaancgggttacaggtgggcaggttggggtctggggacctagaccttcactctacaccagtccaggccagactggacgccgtagtaacgtatttgcgttagttcgtattactgtacagtctagttanacgttccttaacctctaaccgttccgttacggtaccggttaccgggaccgtaaaacggggtacccgtaaaagggtacggaaaacgtaccgaaaacggtaacgtaggtcggacctcgaacgtacctatctcgtaccttcacttcccg

SEQ ID NO: 372940 - DNA, 569 bp, Homo sapiens
  misc_feature: GZ8MTXP02F3SHA.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctctggaagtactaccagttccactacttataccatcaactggtgcgccgacggcccctggacaaggcttgaggtggagtgggtaggaatctactcccttgttttggctccactccacctacgcacgagcgtccggggctagaactacgattaccgacgacaacgtccacagacacagtcctacatgacaagtgagtttcttagaaactccgacgacaccggccgttacacgtatgtagcgacggtacgtcccgtaacccagccttacgcgtaagtcggaacgtccgtttagacgtacgtcggtacgggggactaacggggtaacccg

SEQ ID NO: 372941 - DNA, 521 bp, Homo sapiens
  misc_feature: GZ8MTXP02IX35B.44.74.G08.1.454.CMB.2.raw
  modified_base (232)..(232): a, c, t, g, unknown or other
  modified_base (242)..(242): a, c, t, g, unknown or other
  modified_base (279)..(279): a, c, t, g, unknown or other
  modified_base (356)..(356): a, c, t, g, unknown or other
  modified_base (407)..(407): a, c, t, g, unknown or other
  modified_base (421)..(421): a, c, t, g, unknown or other
  modified_base (491)..(491): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcngcacggcctnggaatctacagttccactactataccatcaactggtncgccaggcccctggacaagggctgagtggagtggggtggaatcactccctcttttggctccactcacctacgcacgngacttccggggcagattacgattaccgcgacagtacccacagacacagtcnccatgacatgattnttagaatccgacgacgacggcctactactactgtgcgagtacggtcccgtacccacgctcgcactggacncttagacgacgtcgaggggtcacgggtacc

SEQ ID NO: 372942 - DNA, 547 bp, Homo sapiens
  misc_feature: GZ8MTXP02JZODF.44.74.G08.1.454.CMB.2.raw
  modified_base (337)..(337): a, c, t, g, unknown or other
  modified_base (374)..(374): a, c, t, g, unknown or other
  modified_base (523)..(523): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggagtgggtggaatcatcccttntttttggctccactcacctacgcacgagctccggggnagatacgattaccgcgacaagtccacagacacagtctccaatgacaatgtagttcttagaatcgacgacacgcgtctactctgtgcagtcggtaccgtaccccaggcctcggaccagttagggactcccgtttaggacgtagttccggngggggaccaacgggggtaaccccg

SEQ ID NO: 372943 - DNA, 565 bp, Homo sapiens
  misc_feature: GZ8MTXP02FZNCS.44.74.G08.1.454.CMB.2.raw
  modified_base (243)..(243): a, c, t, g, unknown or other
  modified_base (339)..(339): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctntggaagtactaccagttccactacttataccatcaactggtgcgccacggcccctggacaagggcttggagtggagtgggtaggaatcactccctntttttggctccactcacctacgcacgacgtcgtccgggcagtaacttacgaattacccgcggaacaagtacccactacgacacagtccaccatcgaacaatgaagtttcttagaaactccgaacgacaccggcctactactacgtgtcgacgagacggtccgtacccagacctcgacagtggacgtccgtttagacgtacgtacggtcggggacgacggtaacccg

SEQ ID NO: 372944 - DNA, 649 bp, Homo sapiens
  misc_feature: GZ8MTXP02JZGHN.44.74.G08.1.454.CMB.2.raw
  modified_base (334)..(334): a, c, t, g, unknown or other
  modified_base (373)..(373): a, c, t, g, unknown or other
  modified_base (415)..(415): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctcgtggaagtactaccagttccactacttataccatcaactggtgcgccaggcccctggacaaggcttgagtggagtggtggaatcatccctnttttggctccactcacctacgcacgagccgttccggggnagaattacgacttaccgcgacaacgtccacagacacagtccnccaagtacgactaataggtagtttacgtttacgaaacttcccggaaccgtaaccgaccggtcccggttaccttaaccgttacgtaggttacggaccggtaacgggtaaccgggttcccccggttaaacccccgacggtcccgttaccggacctaaacggttcggggaaccgtcccggttttaggacggtaacgttcggggtacgggggaccggtaaccgggggttaaaccccgg

SEQ ID NO: 372945 - DNA, 654 bp, Homo sapiens
  misc_feature: GZ8MTXP02GMAGN.44.74.G08.1.454.CMB.2.raw
  modified_base (271)..(271): a, c, t, g, unknown or other
  modified_base (336)..(336): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttanaccatcaactggtgccgccacggcccctggacgaaggcttgaggtggagtgggtgatcgatcctnttttcggctccactcacctacgcacgagaccgttccggggactagtaattacgactaccgcggaacaacgtcccaacacgacaacacgtcctaccagtagaactaaatgtaacgtttactttaacgaaaacgttacccggaaacgaaccgtaacccggcccgttacctaacttaaccgtgtacggacggtaaacggtaaccgggttcccccgttaacccccgaacggtccgttacccggacgtaacgttcgggaaccgttcccgttttaggaacggtacgttccgggtacgggggaccgtaacggggtaaacccccgg

SEQ ID NO: 372946 - DNA, 738 bp, Homo sapiens
  misc_feature: GZ8MTXP02GWQS2.44.74.G08.1.454.CMB.2.raw
  modified_base (236)..(236): a, c, t, g, unknown or other
  modified_base (357)..(357): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggagttcctctttgtggtggcagcagcaacaggtgtccagtccctggtgcaacgtggtgcagtcgtgggactagaatcgccgcaaccttggtcctcggtcgtaccctttcngccacggtcctgtggaactacctaccagttcccactacttactaccatcaacgtggtcgcgccacggcccctggacgaagggtcttggaggtggagtgggtaggtaatctacttcccgttntttttacggctcccgtactccaccctacgccgtaacgacgtccgttccggggactaaacgtaacgttacgacgtttaacccggaccggtaaacaacgttacccaacgaacgaccgaacctacggtcccttaccaaagttacgaaacctaaagttagtaacgttttaccgttttaaggaaaacctttcccgggaaacccgaaccggaaccccgggtacccggttaaccttaaccgttaaccgttggttaccgggaacggtaacggtacccgggtttacccccgtaaccccgaacggtcccgttccgacgtaacggttcggaacgttcccgtttaggacgtacggtccgggtacgggggtacccaaacgggggtttaaccccg

SEQ ID NO: 372947 - DNA, 551 bp, Homo sapiens
  misc_feature: GZ8MTXP02FPT4C.44.74.G08.1.454.CMB.2.raw
  modified_base (271)..(271): a, c, t, g, unknown or other
  modified_base (285)..(285): a, c, t, g, unknown or other
  modified_base (336)..(336): a, c, t, g, unknown or other
  modified_base (407)..(407): a, c, t, g, unknown or other
  modified_base (433)..(433): a, c, t, g, unknown or other
tcagacagtatatacacgaccggtgctcgatttagtagctctatcagggggagcatcacataacaaccatattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttanaccatcaactggtncgccacggcccctggacaagggcttgagtggatgggtggatcacttccctntttttcggctccactcacctacgcacgagcgtccggggacagaattacgactaccgacgaacaacgtccanacgacacagctacatgacatgtattnttagaatccgaacgacaccggctcgtactacgtgtacgcgagtacggtccccgtaccacgcctcgcgacgtggacgtccgtttagacgtacgtcggtcgggggccaacggggtaaccg

SEQ ID NO: 372948 - DNA, 553 bp, Homo sapiens
  misc_feature: GZ8MTXP02F1RDR.44.74.G08.1.454.CMB.2.raw
  modified_base (342)..(342): a, c, t, g, unknown or other
  modified_base (361)..(361): a, c, t, g, unknown or other
  modified_base (470)..(470): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttcctgcacggtcctctggaacgtactaccagttccactacttactaccatcaactggtgccgccacggcccctggacgaagggcttgagtggagtgggtggatcactcctnttttggctcactcactacncacgagcgtccgggcagaatacgataccgcgacagtccacagacacagtcctacatgacaatgtagttctttagaaatccgaacgacgaccggccttactactacgtgngtcgaagacggtacccgtaccccagacctcgcaagtcggacgtccgtttggagtacgtcggtcgggggacacggggtaacccg

SEQ ID NO: 372949 - DNA, 572 bp, Homo sapiens
  misc_feature: GZ8MTXP02IRXOH.44.74.G08.1.454.CMB.2.raw
  modified_base (235)..(235): a, c, t, g, unknown or other
  modified_base (406)..(406): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgtacccttttccngcaccggcctctggaagtacctaccagttccactacttataccatcaactggtgcgccacggcccctggacaaggctgagtgagtggtggaatcatccttcttttggctccactcacctacgcacgacgcgttccggggcaagtaattacgattaccggcgacaagtccanagacacgagtcctcgatcgacatgtatttcttagaaattcccgacgaccgacggtcctactactacgtgtacgcgacggtaacggtcccgtaccccagtcctcgaccgtagtcgggacgttccgtttggaacgtcgtcggttcgggggacctaacggggtaccccg

SEQ ID NO: 372950 - DNA, 544 bp, Homo sapiens
  misc_feature: GZ8MTXP02JC9SX.44.74.G08.1.454.CMB.2.raw
  modified_base (196)..(196): a, c, t, g, unknown or other
  modified_base (363)..(363): a, c, t, g, unknown or other
  modified_base (386)..(386): a, c, t, g, unknown or other
  modified_base (441)..(441): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccgaggggaaagngccaccctctcctgcagggccagtcagagtgttgaccaaaactcttagtctggttccagcagaactgcagactccaggctcctcatctatggtgcatccagccgagggcctcgtggcacgtcccggactaggttcagtggcaggtgggtcgtgggacaggtacttcnctctcacatcagcagacgtgganccgtagaacgttgtttgcgtagttgtattactgtacaggtctagtatgtcttacncctactctgtacgttcggacgaagggaccgtaaggtagaaactacgaaaacgacgtacgtacggctacgcaacgtacgttctagttccttcgtactttccccg

SEQ ID NO: 372951 - DNA, 553 bp, Homo sapiens
  misc_feature: GZ8MTXP02HSA12.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccaggcccctggacaagggcttgagtggagtgggtggaatcatccttcttttggctccactcacctacgcaccgagccgttccggggacagtaattacgattaccgcgacaagtccacagacacagtcctcatgacatgtagtttctttagaaactccgacgaccacggcctactactactgtgcgtagacgtcccgtacccagtcctcgacacgttcggcgtcccgtttggacgtacgtcggtcgggggaccaacggggtacccg

SEQ ID NO: 372952 - DNA, 584 bp, Homo sapiens
  misc_feature: GZ8MTXP02FSGB3.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagaatgccgcaaccttggtcctcggtcgtaccctttctgcacggcctctaggaatactacctagttccactacttataccatcaactggtgccgccacggccccgtggacgaagggtcttggagtggagtgggtaggaatctactcccttgttttcggctcccactccactacgcacgtagccgtcgggacagtactacgactaccgcgacagtaccacagacactagtctaccgatgactacgtagtagttactttagtactaccgacgacaccgccgtactacgtaactgtacgacgtacggacggttacccgtacccgtacgcctaccgctacgtcgtacgtccgtttagacggtacgtcggtcggggacgacgggtaacccgg

SEQ ID NO: 372953 - DNA, 656 bp, Homo sapiens
  misc_feature: GZ8MTXP02FYF3D.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttcctgccacggcctcgtaggaacgtactaccagttccactacttataccatcaactggtgcgccaggcccctggacaaggctgagtggatgggtgaatcgacttccctgttttggctcctacctccacctacgcacgacgtccgttccggggacagtaaacttacgaacgttaccgacggaacaacgtcccagaacgacaacgacgtcctaccaatcgaaacagttagaacgtttctttaagaaacgttcccggaaacgtaccaacccgggccgttactaaccgttacgtggtacggccgtaacggtaccgggttacccccgtacccccgaggtccgttacccggcctaaggtccgggtagttccccgttttagggaaacgtacggttccgggacggggggtaccgtaaccgggggtaaccccg

SEQ ID NO: 372954 - DNA, 590 bp, Homo sapiens
  misc_feature: GZ8MTXP02IBOHJ.44.74.G08.1.454.CMB.2.raw
  modified_base (389)..(389): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgcaaccttggtcctcggtcgtaccccttttctgcaccggcctctggaagtacctaccagttccactacttactaccatcaacgtgggtgcgccacggcccctggacgaagggcttggagtggagtgggtgaatcatcccttctttttggctccactccacctacgcacgacgtcgttccggggnaagtaacttacgacgttaccgcggaccaaagtccaacgacgaacacagtctccatcgacaatgtagtttactttagaaactccgacgtaacaccggcctactactacgttgcgtacgacgtacggtccctaccacgtccgcgctacgttcggacgttccgtttgaaacggtcgtacggtcgggggacctaacgggggaccc

SEQ ID NO: 372955 - DNA, 526 bp, Homo sapiens
  misc_feature: GZ8MTXP02ICU2B.44.74.G08.1.454.CMB.2.raw
  modified_base (332)..(332): a, c, t, g, unknown or other
  modified_base (351)..(351): a, c, t, g, unknown or other
  modified_base (482)..(482): a, c, t, g, unknown or other
  modified_base (509)..(509): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccacgcccctggacgaagggctgagtggatgggtgatcatccttntttgctccactcacctacncacgagcgttcgggcagtaatacgattaccgcgacaagccaacagacacagtctcatgacaatgtatttcttagaatccgacgacaccggctactactactgtcgacgagacggtcccgtacccagcgtcncagtcgacgtcgttgacgtacgtcggnggggtacacggtacccg

SEQ ID NO: 372956 - DNA, 561 bp, Homo sapiens
  misc_feature: GZ8MTXP02JGDGD.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctggactagaatgccgcaaccttggtcctggtgaccctttctgcacggcctctggaagtactaccagttccactacttataccatcaactgggtgcgccaggcccctggacaagggcttgagtggatgggtggaatcgatccctgtttttcggctccactcacctacgcacgagccgttccggggcagattacgagttacccgcggacaagtccacagacacacgtctccgatgaactaagtgtagttcctttagaaactcccgacgaccgacggtccgtctactacgtgtcgacacggtacggtcccgtacccagcctccgcacgtcggacgtccgtttagaggtactccgtgggggaccacgggtaacccg

SEQ ID NO: 372957 - DNA, 841 bp, Homo sapiens
  misc_feature: GZ8MTXP02GGHPZ.44.74.G08.1.454.CMB.2.raw
  modified_base (272)..(272): a, c, t, g, unknown or other
  modified_base (286)..(286): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggagttcctctttgtggtggcagcagcaacaggtgtccagtccctggtgcaactggtgcagtctgggactagaatgccgcaaccttggtcctcggtcgaccctttctgccacggcctgtggaacgtactaccagttccactacttanaccatcaactggtncgccacggcccctggacaaggcttgagtggagtgggtaggaactcgtaacttccccgttagtttttcgggccttaccccgtaaccttccctaaaccccgttaaccggtcccgtaaacccgggtaaccgttacccgggttttcccccggggggaacctaaacggggttaaaaaccgtttaacccgggtaaaacgttttaaccccgggaccgggtaaacccgtaaaaccggttacccccaaaccgaaacgaaacccgtaaacccgtaaacggttcccttaccccgaaagttaccggaaaaccctaaagtttacggttaaacgttttaccgtttttaaacggaaaaaccgtttaccccgggaaaccggtaaccgtaaccccggggtaccccggttaccttaaaccgttaacgttcggtacggacggtaacgggtaccgggttaccccgttaaacccccgaacgtcccgttaccggacgtacggttaccgggacgttcccgttttacggaagttaccgtccggttacggggggacccgaaacgggggttaaacccccgg

SEQ ID NO: 372958 - DNA, 559 bp, Homo sapiens
  misc_feature: GZ8MTXP02JMZDR.44.74.G08.1.454.CMB.2.raw
  modified_base (285)..(285): a, c, t, g, unknown or other
  modified_base (334)..(334): a, c, t, g, unknown or other
  modified_base (425)..(425): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgccacggcctctggaagtctaccagttccactacttataccatcaactggtncgccaggcccctggacaagggctgagtggatgggtggaatcatcccttntttttggctcccgactcacctacgcacgagccgttccggggcaagaacttacgaactttaccgacggaacaagtcccacagacacagtccnccgatgacaatgatttcttagaactccgacgtacaccgtccgtactactactgtgcgagaccggtccgtaccccagcctcgccagtcggaactccgtttggagtacgtcggtcgggggacgacgggtaacccgg

SEQ ID NO: 372959 - DNA, 595 bp, Homo sapiens
  misc_feature: GZ8MTXP02JMHM0.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttcctgcacggcctcgtggaatctacagtccactactactaccatcaacgtggtgccgccgacggcccctggacgaacgggtcttggaggtggagtggggtaggaatctacttcccttcgttttcgctcccactccacctacgcacgacgtccgttccggggacagtaacttacgacttaccgacggtaacacgtcccacgaagacaactacgtcctaccatcgaactagtagtacgtttacttacgaactaccgacgaccgacggtccgtactactacgtgtcgacgtacggtacggtcccgacccacgcctcgactacgtggacgtcgttagacgtacgtcgggtcgggacgtacgggtaccg

SEQ ID NO: 372960 - DNA, 751 bp, Homo sapiens
  misc_feature: GZ8MTXP02GO81Y.44.74.G08.1.454.CMB.2.raw
  modified_base (289)..(289): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccttttcctgcacggcctcgtggaacgtactaccagttccactacttataccatcaacgtggtncgccacggcccctggacgaggtctggagtggagtgggtagaactctactcccttgttttcggctccactccacctacgcaacgtacgtccgttccggggacaacggtaaacttaccgtacgttacccggacgggtaaactaacggttacccaacgaacggaaccaacgtacgtaccttacccaagttacgaacctaaagttacggtaacgtttttaccgtttaacggaaaaccgttaccccggaaaccggtaaccctaaccccgggggttacccgttaccttaaacccgttaaccgttcgggttaaccggaccgggtaaacgggtaacccgggtttaccccccggtaacccccgaacggtccccgttaccggaccgtaacggttcggggtaaaccgttccccgttttagggacgttacggtttccgggtacggggggacccgtaaccggggttaaaccccgg

SEQ ID NO: 372961 - DNA, 592 bp, Homo sapiens
  misc_feature: GZ8MTXP02FMQDI.44.74.G08.1.454.CMB.2.raw
  modified_base (270)..(270): a, c, t, g, unknown or other
  modified_base (491)..(491): a, c, t, g, unknown or other
  modified_base (520)..(520): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctctggaagtctaccagttccataccttanaccatcaactgggtgcgccaggcccctggacaagggcttgagtggagtgggtggaatcgtacttccccttagtttttggcctccactccaacctacgcacgagccgttccggggcaagtaacttacgaattaccggcggaactaagtcccacagtacacagtcctacatagacatgacttctttagaaactccgacgacaccggtccgtactactcttggngacgacggtacggtcccgttaaaccccgngtacctcggactacgtcggacgtcccgtttaggaaacgtcgtaccgggtgggggaccacgggggttaacccg

SEQ ID NO: 372962 - DNA, 567 bp, Homo sapiens
  misc_feature: GZ8MTXP02GLQZC.44.74.G08.1.454.CMB.2.raw
  modified_base (291)..(291): a, c, t, g, unknown or other
  modified_base (339)..(339): a, c, t, g, unknown or other
  modified_base (413)..(413): a, c, t, g, unknown or other
  modified_base (539)..(539): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccaatccctggtgcaactggtgcagtctgggactagaatgccgcaaccttggtcctcggtcgtacccctttcctgcaccggcctcgtggaagtactacccagttccactacttataccatcaactggtncgccaggcccctggacaagggcttgagtggatgggtggaatcatcctntttggctcacctcacctacgcacgacgacttccggggacagaattacgattaccgcgacaagtcccacagacanagctcatgaacatgattccttagaactccgacgtacaccggccgttactactactgtagacggagaccggttcccgtaaccccgacggtcctcgaccaagttcgggaacgtcccgtttagaacgtntccggtagggggccaaggggtaaccccg

SEQ ID NO: 372963 - DNA, 608 bp, Homo sapiens
  misc_feature: GZ8MTXP02HZNKL.44.74.G08.1.454.CMB.2.raw
  modified_base (346)..(346): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccccttttcctgccacggcctcgtaggaaactacctaccagttccactacttataccatcaactggtgcgccacggcccctggacaagggcttggagtggagtgggtggaatcatcccttnttttggctccactccacctacgcacgagtcgttccggggcagaacttacgacttaccgacgacaagtccacagacacagtcctaccatagacaatgtagtttctttagaaattccgacgacaccggaccgtctactactagtgacgacggtacggtccccgttaccccgacgtccgtaccgacgtacgtacgggacgttccccgtttttaggaacggttacgtccggggtcggggggtaccgtaacgggggttaacccccgg

SEQ ID NO: 372964 - DNA, 658 bp, Homo sapiens
  misc_feature: GZ8MTXP02IK4TK.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacgaggtgtccagtcccgtggtgcaacgtggtgcagtcgtgggactagaatgccgctaaccgttggtcctcggtcgtaccccttttccgtgccacggccttcgtaggaaaacttcctacctacgttacccacttaccttactaaccataccaacgtggtcgccgccgacggccccgtaggacgaagggtctaggagtggtagtgggtagaatctacttccttcgttttgctccactcaccgtacgcacgacgtccgtccggggactaaagtaacttacgacgttaccgacgaacaacgtcccaacagaaccacacgtcctaccgaatacgactaaagttagtacgtttacttaaacgtaaacgtcccgtaacggacgacccggtacctacttaacgtacgtgtacggacgaacggtacccggtccccgtaccccgagtccgtacgccgtagtcggacgttcgttacggacgtacgtcgggtacggggaccgtaccgggtacccg

SEQ ID NO: 372965 - DNA, 620 bp, Homo sapiens
  misc_feature: GZ8MTXP02G6N9C.44.74.G08.1.454.CMB.2.raw
  modified_base (349)..(349): a, c, t, g, unknown or other
  modified_base (385)..(385): a, c, t, g, unknown or other
  modified_base (420)..(420): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttcctgccacggcctctggaacgtacctacagttccactacttactaccatcaacgtgggtgccgccacggcccctaggacgaagggtcttggagtggagtgggtagaatcactccttntttggctccactcacctcgcacgagtcgtccggganagtaatacgataccgcgtaacacgtccacagacanacgtcctaccaagtacgaactaagtagtacgttttacttaacggtaaaactcccggaaacgaaccgaccggtacccgttacttaacgtccttaggtcgaacgtaacggtaccggtaccccgtaacccgacgtcctacgacgtaacgtcgggaactccgtttagacggtacgtcggacgggggtaccaacggggtaacccg

SEQ ID NO: 372966 - DNA, 624 bp, Homo sapiens
  misc_feature: GZ8MTXP02IGN2V.44.74.G08.1.454.CMB.2.raw
  modified_base (193)..(193): a, c, t, g, unknown or other
  modified_base (298)..(298): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctccagataacaccggagaaattgtgttgacgcagtctccaggcaccctgtctttgtctcgaggggaaangccaccctctcctgcgagggccagtcagagtgttagaccaaaaattcttagtctggttccagacagaaacctggaccagacctcccaggcctctacatctatggncatccagcgaggcctgtggctacgtccggataggttcaggtggacgtacgggttcggggtctaggggactaggtaccttcgactctacgacccagtccagctacggactgggaacgtccgtagtacgttagtttgacgttagtagtattacgtgtactagacgtagttactacgttaccttacgtacctaccgtcgtacgtaccggttaccgggaccgtaaacgggaaccgtagggtaaacgtaaactaacgaaaacggttacgttacggtacgtaacgtacgaaccgtactaacgttcctggtttaccttacgtactttaccccg

SEQ ID NO: 372967 - DNA, 558 bp, Homo sapiens
  misc_feature: GZ8MTXP02JGQX4.44.74.G08.1.454.CMB.2.raw
  modified_base (184)..(184): a, c, t, g, unknown or other
  modified_base (340)..(340): a, c, t, g, unknown or other
  modified_base (424)..(424): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtncagtctgggactagaatgccgcaaccttggtcctcggtcgtacccctttcctgccacggcctcgtggaatcctaccagttccactacttataccatcaactggtgcgccacggcccctggacaagggtctgagtggagtgggtggatcatcccttnttttggctccactcacctacgcacgacgtcgtccggggacagaattacgattacccgcgacacgtaccacgagacacgagtccnccatgacaatgtattcttagaattccgagacacggtcctactactactgtcgacgaggtaccgtcccgtaacccgcgtacctcgcaacgtcggacgtccgttggacgtacgtcggcggggacgacgggtacccg

SEQ ID NO: 372968 - DNA, 565 bp, Homo sapiens
  misc_feature: GZ8MTXP02GNAII.44.74.G08.1.454.CMB.2.raw
  modified_base (243)..(243): a, c, t, g, unknown or other
  modified_base (334)..(334): a, c, t, g, unknown or other
  modified_base (426)..(426): a, c, t, g, unknown or other
  modified_base (503)..(503): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctntggaacgtactaccagttccactacttataccatcaactggtgcgccaggcccctggacaagggcttgagtggatgggtgaatcatccctntttggctccactcacctacgcacgagcgtccggggcagaattacgattaccgcgacagtccacagacacagtcctcatgacatgtacgtttnttagaaatcccgaagaccacggccgtctaactacgtgtcgtcgaacggacggttcccgtaccccacggcttacccgngtaacgtcggaacgtcccgtttggaacgtacgtccggtagggggcccaacgggggtaacccg

SEQ ID NO: 372969 - DNA, 547 bp, Homo sapiens
  misc_feature: GZ8MTXP02GCSBW.44.74.G08.1.454.CMB.2.raw
  modified_base (335)..(335): a, c, t, g, unknown or other
  modified_base (462)..(462): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgtacccctttcctgcacggcctctggaagtctaccagttccactacttataccatcaactggtgcgccaggcccctggacaagggcttgagtggagtgggtgaatcatccctnttttggctccactcactacgcacgagcgttcggggcagaattacgagttaccgcgaacaagtccacagacacagtctccatgaacatgattctttagaaactccgacgacacggtccgtactactangtgcgagtacggtcccgtacccacggcctacgcaacgtcggacgtccgtttgaacgtctcggtacgggggcaacgggttaacccg

SEQ ID NO: 372970 - DNA, 599 bp, Homo sapiens
  misc_feature: GZ8MTXP02IH7G6.44.74.G08.1.454.CMB.2.raw
  modified_base (231)..(231): a, c, t, g, unknown or other
  modified_base (241)..(241): a, c, t, g, unknown or other
  modified_base (332)..(332): a, c, t, g, unknown or other
tcagacagtatatacacgaccggtgctcgatttagtagctctatcagggggagcatcacataacaaccacattcctcctctaaagagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcngcacggcctntggaatctacagttccactacttataccatcaactggtgcgccaggcccctggacgaagggcttggagtggatgggtaggatcattccctnttttggctccactcacctacgcacgacgtcgttccggggacaaggtaactttacgaactttaccggacggtaaccaagtcccaacacgaacacgagtcctacatgaacatagtacgtttctttaggaaacttccgacgaacgaccggtaccgtacttacgtactgtcgacgacggtacggttacccggaccccaaggccttacgccgaagttcgggacttcccgtttgaacgtacgtcggttacgggggtaccgaacgggtaacccg

SEQ ID NO: 372971 - DNA, 561 bp, Homo sapiens
  misc_feature: GZ8MTXP02H8WB0.44.74.G08.1.454.CMB.2.raw
  modified_base (362)..(362): a, c, t, g, unknown or other
  modified_base (497)..(497): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccttttctgcacggccttgtggaagtacctaccagttccactacttataccatcaactggtgcgccacggcccctggacaaggcttgagtggagtggtagatcatccttcttttggctccactccactacgcacgancgtccgggcagtactacgactacgcgacagcacagacactacgtcctacatacgactaagtgtagtttcttaagaacttccgaacgacgaccggtacctctactcgtagtgacgacgtacggtacccgtaacccngcctcgacacgttcggaacgttccgttaggacgtacgtacggtcgggggactaacgggtacccg

SEQ ID NO: 372972 - DNA, 618 bp, Homo sapiens
  misc_feature: GZ8MTXP02I5EQ7.44.74.G08.1.454.CMB.2.raw
  modified_base (298)..(298): a, c, t, g, unknown or other
  modified_base (542)..(542): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagaatgccgctaaccgttggtcctcggtcgtacccctttcctgccacggcctcgtaggaacgtactaccagttcccactacttataccatcaacgtggtcnccgccacggcccctggacgaagggcttgagtggagtggggtaggaatcactcccttgtttggctccactcacctacgcacgagtccgttccgggctagaacttacgacttaccgcgaacacgtccacgacgacacacgtcctaccaatcgaactaataggtactttcgttaagaaactccggaacgaccgaccggtcctacttacctcgtgtcgacggacggtaccggtaccccgtaaccccgngtaccctcgacctacggtcggaacgttcccgtttagaacgtacgtcgggtacgggggaccgaacggggtaaccccg

SEQ ID NO: 372973 - DNA, 645 bp, Homo sapiens
  misc_feature: GZ8MTXP02FORQB.44.74.G08.1.454.CMB.2.raw
  modified_base (184)..(184): a, c, t, g, unknown or other
  modified_base (290)..(290): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtncagtctgggactagaatgccgcaaccgttggtcctcggtcgtaccctttctgccacggcctcgtggaagtactacagttccactacttactaccatcaactgggtnccgtccacggcccctggacgaaggcttgagtggagtgggtggaatctactcccttgttttcgcttccacctccactacgcacgacgtccgttccggggctacgtaacttacgaacgttaccgacggaactaagtcccaacacgaacactacgtcctaccatagaaccaagttcgtacgtttactttacgaaacgttcccgaacgtaccgaccggccgttactaacgtacgtgtacgcggtaacggtaccggttaccccgaaccccgtaaacgtccgaccgtacgtacggaccgttacccgtttaagacgtaacggttcggtaccgggggactaaccgggggtaaccctttcgggg

SEQ ID NO: 372974 - DNA, 662 bp, Homo sapiens
  misc_feature: GZ8MTXP02HZ4YW.44.74.G08.1.454.CMB.2.raw
  modified_base (235)..(235): a, c, t, g, unknown or other
  modified_base (286)..(286): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaacctttggtcctcggtgacccctttccngcacggcctctggaatactacagttccactacttataccatcaactggtcncgccaggcccctggaccaagggcttgggagtagtggtgggtagactcgtacccttccgtttttcggttcgtcctaccctacctacctacccgtacgacgaacggtacgttcccggggtccgggaactaaacgttaaccgttaacgtaccgtaccgggaccgaaacgtaccgaccacgaacgaccacgtactaccagtacgacaactagtagtttacgtttacgtaaacgtaaccgaccggaacgacggacccgttcgtaacttaccgtagttcggacgacgtaacggtacccggtacccctaccgtacgtcggtccagtacgtacggcctttaacggttacgaagttcgtcgggggacggacgtaacccggtccgg

SEQ ID NO: 372975 - DNA, 712 bp, Homo sapiens
  misc_feature: GZ8MTXP02IFB14.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagaatgccgctaaccgttggtcctcggtcgtacccctttccgtgccgacggccttcgtaggaacgttacctacctagttcccactacttactaccatacaacgtgggtcgccgccgacggccccgtaggacgaagggtcttaggagtggagtggggtaggaaatcgtacttccccgtttgtttttcggccttccctaccttaccgacccttaccgcgaaccggtacgtaccgttccgggggactaacggtaaacttaccgtaacgttacccgacggaacaaacgtcccaacaacgacaacgtacgtcctaccaagtacgaaacctaagttcggtaacgtttactttaacggaaaactcccggaaccgaaccgacccgggtaccttacttaacgtacgttcggtacgacggaacggtaccggtaccccgtaaccccaggtccgtaccgacgtaacgtcggaacgtccgtttaggaacgtcggttaccgggtcgggggaccgtaaacgggtaacccg

SEQ ID NO: 372976 - DNA, 610 bp, Homo sapiens
  misc_feature: GZ8MTXP02F1XZL.44.74.G08.1.454.CMB.2.raw
  modified_base (193)..(193): a, c, t, g, unknown or other
  modified_base (216)..(216): a, c, t, g, unknown or other
  modified_base (226)..(226): a, c, t, g, unknown or other
  modified_base (270)..(270): a, c, t, g, unknown or other
tcagacagtatatacacgaccggtgctcgatttagtagctctatcagggggctggggtctcaggaggcagcgctctcgggacgtctccaccatggcctgggctctgctgctcctcactctcctcactcaggacacagggtcctgggcccagtctgccctgactcagcctgcctcgtgtctggtcgcctggacngtcgtcacatctcctgcatggancagcgtaatnttctagtcttaacttgtctctgtatcaacatcatccaggtaacnccccaaatcatcatctatgacggtacctaagtaagacggtcccctagtaggggtttactaactccgtcttcactcgtccctaccgaacgtcccggaccaaaccgaccggtcccctccctagaactaacttcctcgtcgggccttaccgaggtctacggaggaaccgagggtctagtatttattagttgttgtctcgagtattcgttcgtcgctattcctatttatcgttacgttacgggtaaggtcgggtaaacctaacggtcccgtaaaccggtccgtaacggtaaccgaacccggaccccgaaaccggacccccaaaacccccgtcgtaccgtaaccc

SEQ ID NO: 372977 - DNA, 568 bp, Homo sapiens
  misc_feature: GZ8MTXP02JZ95S.44.74.G08.1.454.CMB.2.raw
  modified_base (285)..(285): a, c, t, g, unknown or other
  modified_base (330)..(330): a, c, t, g, unknown or other
  modified_base (403)..(403): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctctggaacgtactaccagttccactactataccatcaactggtncgcaggcccctggacaaggctgagtggatggtggatcatcccttnttttggctccactcactacgcacgacgcttccggggcagattacgattaccgacggacaagtccacagacacngctccatgactaatgagttctttagaactcgaacggaccacggtcccgttactacctacgtgttcgacggaacgtacgggtaccccttacccgacgtccgttacgcctaaagtggaacgttcccgtttagacgtacggtacgtcgggggacaacggggtaacccg

SEQ ID NO: 372978 - DNA, 605 bp, Homo sapiens
  misc_feature: GZ8MTXP02HF36O.44.74.G08.1.454.CMB.2.raw
  modified_base (290)..(290): a, c, t, g, unknown or other
  modified_base (306)..(306): a, c, t, g, unknown or other
  modified_base (488)..(488): a, c, t, g, unknown or other
tcagacagtatatacacgaccggtgctcgatttagtagctctatcaggggagagctgctcagttaggacccagagggaaccatggaaaccccagcgcagcttctcttcctcctgctactctggctcccagataacaccggagaaattgtgttgacgcagtctccaggcaccctgtctttgtctccgaggggaaagagccaccctctcctgcagggccagtcagagtgttcgaccaaaaactctagtctggttccagcagaactggcagactccagctcctcatctatgtncatccagcgaggcctntcgggcacgtcccgggatacggttcaggtcggcacggtcggggtctaggggacctaggtaccttcacctccgtcaaccgtagtccaagcagtacgtggacgtaccgtaggtaaagttacgtttcggctaaggttgttaacttacgtgttacgaacggtcgtagtaagtcgtacctttaaccnccgtacgtcgtacggtacgtaccgaacggaacggtaacgtaaacggtacgtaaactaccgtaaacgtacgtacggacgtactacgaacgtacgtctacgtacgtctacgtacctccg

SEQ ID NO: 372979 - DNA, 564 bp, Homo sapiens
  misc_feature: GZ8MTXP02GSB09.44.74.G08.1.454.CMB.2.raw
  modified_base (221)..(221): a, c, t, g, unknown or other
  modified_base (241)..(241): a, c, t, g, unknown or other
  modified_base (336)..(336): a, c, t, g, unknown or other
  modified_base (356)..(356): a, c, t, g, unknown or other
  modified_base (361)..(361): a, c, t, g, unknown or other
  modified_base (372)..(372): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctggactagatgccgcaaccttggtcctcggtnacccctttctgcacggcctntggaagtactaccagttccactacttataccatcaactgggtcgcgccacggcccctggacaagggcttgagtggagtgggtgaatcactccttnttttggctccactcactacncacgngacgtccgggnagtaactacgacttaccggcgacaacgtccaacacgacacacgtctccatcgacaatgtagttacttagaaactccgacgacgaccggtcgtctacgtacagtcgacgacgtacggtcccgtacccgacgtctccggactacgtggtactccgtttaggagtactcgggtacgggggacacggggtaacccg

SEQ ID NO: 372980 - DNA, 566 bp, Homo sapiens
  misc_feature: GZ8MTXP02INBXU.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgctaaccttggtcctcggtcgtaccctttctgcacggcctcgtggaatctaccagttccactacttataccatcaacgtggtgcgccacggcccctggacaagggctgagtggagtgggtagaatcactccttctttggctccactcacctacgcacgagccgttcgggacagtaatacgataccgcgaacaagtccacagacacagtctacatagacaagtgtatttcttagaactacgacgacgacgtccgtactactacgtgtagcgaagtaccggtcccgacccagtccacgacgtacgttcgggacgttccgtttaggacgtacgttcgggacgggggtaccgtaacgggtaacccg

SEQ ID NO: 372981 - DNA, 593 bp, Homo sapiens
  misc_feature: GZ8MTXP02G18RX.44.74.G08.1.454.CMB.2.raw
  modified_base (337)..(337): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccttttcctgcacggcctctggaagtactacagttccactacttatacatcaactggtgcgccacggcccctggacaagggcttgagtggagtgggtggaatcatcccttnttttggctccactcacctacgcacgacgccgttccggggacagaattacgagttaccgacgggaacagtcccaacgagaaccacgagtcctacccatcgaacagtagtacgtttactttagaaactccggaccgtaaccgacgggtccgttctaactacgtgtcggacgaacggtacggtcccgtacccacgccttcggacctagtcggacgtccgtttagaacgtcgtcggtacgggggcgacggggtaacccgg

SEQ ID NO: 372982 - DNA, 560 bp, Homo sapiens
  misc_feature: GZ8MTXP02HC7LX.44.74.G08.1.454.CMB.2.raw
  modified_base (233)..(233): a, c, t, g, unknown or other
  modified_base (272)..(272): a, c, t, g, unknown or other
  modified_base (288)..(288): a, c, t, g, unknown or other
  modified_base (383)..(383): a, c, t, g, unknown or other
  modified_base (409)..(409): a, c, t, g, unknown or other
  modified_base (416)..(416): a, c, t, g, unknown or other
  modified_base (420)..(420): a, c, t, g, unknown or other
  modified_base (508)..(508): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcngcacggcctcgtggaagtactaccagttccactacttanaccatcaactgggtcncgccacggcccctggacaagggcttaggagtggagtggggtaggaatcattcccttgttttggctccactcacctcgcacgagcgttccgggganagtatacgataccgcggacagtccanagacacngtcnccatcgaactaatgatttctagaaactccgaacgtacgaccgccgtactaactctgtcgacgacgtacggtccctaacccgcgtaccncggctacgtggactccgtttgacgtacgtcggtcggggactaacgggtaccg

SEQ ID NO: 372983 - DNA, 533 bp, Homo sapiens
  misc_feature: GZ8MTXP02JDQOP.44.74.G08.1.454.CMB.2.raw
  modified_base (333)..(333): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaatactaccagttccactacttataccatcaactgggtgcgccaggcccctggacaagggcttgagtggatgggtgaatcagtccctnttttggctccactcacctacgcacgagcgtccggggcagaattacgacttaccgcggacaagtcccacagacacagtctcatgacaatgatttcttagaaatccgagacacggccgtactacactgtgcgagacggtcccgtacccagctcgcagtcggacgtccgttagacgacttcggcgggggacacgggtaacccg

SEQ ID NO: 372984 - DNA, 637 bp, Homo sapiens
  misc_feature: GZ8MTXP02G2OL4.44.74.G08.1.454.CMB.2.raw
  modified_base (357)..(357): a, c, t, g, unknown or other
  modified_base (397)..(397): a, c, t, g, unknown or other
  modified_base (433)..(433): a, c, t, g, unknown or other
tcagacagtatatacacgaccggtgctcgatttagtagctctatcagggggagcatcacataacaaccatattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtctaccctttcctgcaccggtcctcgtaggaacgtacctacctacgttccaactacttactaccatcaacgtggtcgccgccacggccccgtggacgtaagggcttaggaggtggagtggggtagatctctccttnttttcgctcccactcactacgcacgagccgttccgggganagtaacttacgacgttaccgcggtaacacgtaccanacgacacagtcctaccagtacactaagtaggttactttacgtttaacgaaacttcccggaccgtaaccgacccgggtaccttaccttaacgtacgtcggtcgacgtacggtaccggtcccggaccccctaggcctccgcgtaacgtcgggtaactccgtttaggacgtacggttcggaccgggggaccgaacggggttaccccg

SEQ ID NO: 372985 - DNA, 552 bp, Homo sapiens
  misc_feature: GZ8MTXP02I3I4H.44.74.G08.1.454.CMB.2.raw
  modified_base (243)..(243): a, c, t, g, unknown or other
  modified_base (285)..(285): a, c, t, g, unknown or other
  modified_base (399)..(399): a, c, t, g, unknown or other
  modified_base (405)..(405): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctntggaagtactaccagttccactacttataccatcaactggtncgccaggcccctggacaaggcttgagtggatgggtgatcatccttctttggctccactcactacgcacgagcgttccggggcagtacttacgattaccgcggacaagtcccaanagacanagtctcgatgacatgagtttcttagaaactccgacgtaccacggtccgtactactacgtgtgcgtacgacggtccgtaccccagcctcgcaacgtggacgtccgtttaggacgtacgtccggttcgggggactacgggggtaacccg

SEQ ID NO: 372986 - DNA, 540 bp, Homo sapiens
  misc_feature: GZ8MTXP02FJES9.44.74.G08.1.454.CMB.2.raw
  modified_base (360)..(360): a, c, t, g, unknown or other
  modified_base (458)..(458): a, c, t, g, unknown or other
  modified_base (482)..(482): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcatcggtgaccctttctgcacggcctctggaagtactaccagttccactacttataccatcaactggtgcgccaggcccctggacaaggcttgagtggatgggtggaatcatccctctttttggccctcactcacctacgcacgngacttccggggcagaattacgattaccgcgacaagtccacagacacagtctcatgacaatgagttcttagaaactccgagaccacggcctctactacngtgcgagacggtcccgtaaccccngcctcgcctagtacggaacgtcctttaggacgtagtcgtacgggggctaaaccggggg

SEQ ID NO: 372987 - DNA, 621 bp, Homo sapiens
  misc_feature: GZ8MTXP02JLYKW.44.74.G08.1.454.CMB.2.raw
  modified_base (308)..(308): a, c, t, g, unknown or other
  modified_base (405)..(405): a, c, t, g, unknown or other
  modified_base (448)..(448): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatcgccgctaacccttggtccctcggtcgtacccctttcctgccaccggccttcgtagggaacgttacctacctacgttccacttacttataccatacaacgtgggtcncgccacggcccctggacgaaggctggagtggagtggggtagaatctacttcccttgttttgctccactccacctacgcacgacgtccgttccggganagtaacttacgacgttaccgacgaacacgtaccacgagacacncgtcctacagtcgaactagtgtagtttacttagaaacgtccgaccgaacgtaccggtaccgtctaactactggacgtcgacggtacgttcccgacccgagcccgttacgacgtacgtcggacgttaaccgttaggacgtacggtcggtacgggggaccgtacggggtaacccg

SEQ ID NO: 372988 - DNA, 530 bp, Homo sapiens
  misc_feature: GZ8MTXP02FIRZS.44.74.G08.1.454.CMB.2.raw
  modified_base (272)..(272): a, c, t, g, unknown or other
  modified_base (335)..(335): a, c, t, g, unknown or other
  modified_base (410)..(410): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccccttttcctgcacggcctctggaagtctaccagttccactacttanaccatcaactggtgcgccagccccctggacaagggcttgagtggatgggtggaatcatccctntttttggctccactcactacgcacgagctccggggcagaattacgattaccgcgaacaagtccacagacacagcnccatgacaagtgagttctttagaaatccgaacgacaccggccgtactactactgtgcgagacggtccgacccctagctcgcactggagccgtttgagactcgtggggccagggtaacccg

SEQ ID NO: 372989 - DNA, 584 bp, Homo sapiens
  misc_feature: GZ8MTXP02G4J2A.44.74.G08.1.454.CMB.2.raw
  modified_base (232)..(232): a, c, t, g, unknown or other
  modified_base (378)..(378): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcngcacggcctctggaagtctaccagttccactacttataccatcaactgggtgccgccacggcccctggacgaaggcttgagtggagtgggtgaatcatcccttcgttttcggctccactccacctacgcacgagccgttccggggnagtaacttcgattaccgcggaacaagtcccaacacgaacacagtcctacatacgacaatgtaattctttaagaaactccgacgacaccggcgtactactactgtcgacgacgtacggtacccgtaccccagtccctacggctaacgtcgggtaacgtccctttaggacgtacgttcggtacgggggaccgaacggggtaaccccgg

SEQ ID NO: 372990 - DNA, 543 bp, Homo sapiens
  misc_feature: GZ8MTXP02FFXDJ.44.74.G08.1.454.CMB.2.raw
  modified_base (127)..(127): a, c, t, g, unknown or other
  modified_base (319)..(319): a, c, t, g, unknown or other
  modified_base (375)..(375): a, c, t, g, unknown or other
  modified_base (414)..(414): a, c, t, g, unknown or other
  modified_base (443)..(443): a, c, t, g, unknown or other
tcagacagtatatacacgaccggtgctcgatttagtagctctatcagggggagacttcccttcctatgataagagaggcctggaggttcctccttagctgtgggctcagaagcagagttctggggtntctccaccatggcctggacccctctctggctcactctcctcactctttgcatagggtctgtagtttctctggctgactcaggatctgctgtgtctgtggccttgggacagacagtcaagatcacatgcacggagacagcctcaggagggcactatgcaagctggtaccaacagaagccgggacacggccccntacttgcctattgttaggtaaaaccgaccggcccacgggctcccagacgtatctcncgctcccactcgaacgaaacacagtcctccttgaacccntaccacgtcggacctcgacgggacggaanacgtagacggctgactattatgcaagcagtcgggaacagtagtaacgtgtctttacgttgtttaccgacgacccggaccaaacggtacctccgtttaccg

SEQ ID NO: 372991 - DNA, 546 bp, Homo sapiens
  misc_feature: GZ8MTXP02HZ1AB.44.74.G08.1.454.CMB.2.raw
  modified_base (335)..(335): a, c, t, g, unknown or other
  modified_base (344)..(344): a, c, t, g, unknown or other
  modified_base (353)..(353): a, c, t, g, unknown or other
  modified_base (359)..(359): a, c, t, g, unknown or other
  modified_base (371)..(371): a, c, t, g, unknown or other
  modified_base (403)..(403): a, c, t, g, unknown or other
  modified_base (431)..(431): a, c, t, g, unknown or other
  modified_base (473)..(473): a, c, t, g, unknown or other
  modified_base (509)..(509): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaacctttggtcctcggtcgtaccccttttcctgcacggcctctggaatactaccagttccactacttataccatcaactggtgcgccaggcccctggacaaggcttgagtggatggggtgatcatcctntttggctcnctcactacncacgancgttccgggganagaattacgattaccgcgtaacaagtccaacngacacagtcctcatgacaatgtagtttntttgaaaattccgacgtaccacggccgtactactactgtacncgtagacggtcccgtaccccagctcgcgactggacncgtttggacgtagtccgtgggggcacgggggtaaccc

SEQ ID NO: 372992 - DNA, 546 bp, Homo sapiens
  misc_feature: GZ8MTXP02IFWFY.44.74.G08.1.454.CMB.2.raw
  modified_base (235)..(235): a, c, t, g, unknown or other
  modified_base (280)..(280): a, c, t, g, unknown or other
  modified_base (354)..(354): a, c, t, g, unknown or other
  modified_base (426)..(426): a, c, t, g, unknown or other
tcagacagtatatacacgaccggtgctcgatttagtagctctatcgagggggagcatcacataacaaccacattcctcctctaaagaagcccctgggagcacagctcatcaccatggactggacctggaggttcctctttgtggtggcagcagcaacaggtgtccagtccctgggtgcaactggtgcagtctggggactagaatgccgcaacctttggcctggtcgaccctttcngcacgctctggaatctaccagttcactactatacatcaactggtncgccaggcccctgacaggctgagtggatggatggaatcgactccttgttttgaccttcactcacctacgcacgngtaccgttcggggacacgtaattacgattaacccggacgtaacacgtaccacacgacacagtctacataganatagtagttcttagtatacgacgacacgcgtctactactagtgcgtacgacggtaccggtacccacgccgcgacgacgtacgtaacgtcgtacgtacgtacgtcggtacggacggtacgg

SEQ ID NO: 372993 - DNA, 554 bp, Homo sapiens
  misc_feature: GZ8MTXP02F54UV.44.74.G08.1.454.CMB.2.raw
  modified_base (286)..(286): a, c, t, g, unknown or other
  modified_base (315)..(315): a, c, t, g, unknown or other
  modified_base (410)..(410): a, c, t, g, unknown or other
tcagacagtatatacacgaccggtgctcgatttagtagctctatcagggggagcatcacataacaaccacattcctcctctaaagaagcccctgggagcacagctcatcaccatggactgacctggaggttcctctttgtggtggcagcagcaacaggtgtccagtccctggtgcaactggtgcagtctgggactagaatgccgcaacctttggtcctcggtgaccctttcctgcacggcctctggaacgtactaccagttccactacttataccatcaactggtncgccaggcccctgacaaggcttgagtggngtggtggaatcatccctcttttggctccactccacctacgcacgagactccggggcaagaactacgattaccgcgacagtccacagacacagtcncatgacatgattcttagaatcaacgacaccggccgtactactactgtcgacgtagacggtcccgtacccacgtccgtacgccgtaagtcgaacgtcccgttagtaacgtacgtcgtcgggggtacctaacgggggtaaccccgg

SEQ ID NO: 372994 - DNA, 747 bp, Homo sapiens
  misc_feature: GZ8MTXP02JT56K.44.74.G08.1.454.CMB.2.raw
  modified_base (242)..(242): a, c, t, g, unknown or other
  modified_base (659)..(659): a, c, t, g, unknown or other
tcagacagtatatacacgaccggtgctcgatttagtagctctatcagggggagcatcacataacaaccacattcctcctctaaaagaagcccctgggagcacagctcatcaccatggactggacctggaggttcctctttgtggtggcagcagcaacgaggtgtccagtcccgtggtgcaacgtggtgcagtcgtgggactagaatcgccgctaaccgttggtcctcggtcgtaccctttcncgccgacggtctcgtaggtaactacctaccgacgttccctaacttacttaactacctaactactaacggttgggtaccgccggacccgtaccggccccgtagggaaccggtaagggtccgttgggaggtcgggtaggtacggggtagggtaactccgtactttccccgtttacgtttttcggaccttcccctacctccgtaaacccgttaccggaccgtacggtaaccggtacccggggttacccggggtactaaacggttaaacgtttaaccgggtaacgtttaaccccgggacgggtaaaacctaaccgtaccaaccgaacgaacacccgtagtcctaccagtagaactaagtggttactttacgtaagaactaccggaacgacgtaccggtcctagtaccttagtcgtacgggnaccggtaccggtaccccaaccgacgtcgtacgccgtacgcggtacttccggtaagcgtacggtcgggtacggggaacgtaaccggtcg

SEQ ID NO: 372995 - DNA, 602 bp, Homo sapiens
  misc_feature: GZ8MTXP02GETT2.44.74.G08.1.454.CMB.2.raw
  modified_base (234)..(234): a, c, t, g, unknown or other
  modified_base (316)..(316): a, c, t, g, unknown or other
  modified_base (327)..(327): a, c, t, g, unknown or other
  modified_base (345)..(345): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttcngcacggcctgtggaatactacagttccactacttataccatcaactggtgtgccagcccctggacaaggctgagtggatggngatcactcctntttgctccactcactacncacgacgcgttccgggacaagtaactacgtacttaccgacgaacaacgtccaacacgacacacgtcctacatgaaactaagtagtagttactttaagaaacgtcccgaacgaccgtacccggccgttactaacctacgtgtacgacggacggtaaccggtacccgtaccccgaacgccgttaccgccgtaagtcggacgtaaccgttttggaacggttacgtcgggtacgggggtacccgacggggttaaaccccgg

SEQ ID NO: 372996 - DNA, 726 bp, Homo sapiens
  misc_feature: GZ8MTXP02JW40A.44.74.G08.1.454.CMB.2.raw
  modified_base (222)..(222): a, c, t, g, unknown or other
  modified_base (231)..(231): a, c, t, g, unknown or other
  modified_base (241)..(241): a, c, t, g, unknown or other
  modified_base (253)..(253): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctggactagaatgccgcaaccttggtcctcggtnaccctttcngcacggcctntggaatactacngttccactactataccatcaacgtggtcgacgtccaggtcccctggacagggcttggagtggacgtggggtggaatcgacttccccgttgtttttggccttacccgacttccacccgtacgcgaccgacggtaccgttccgggggactaaggtaaacgtttaccggaacgtttaacccgggtaccggggaaacctaaacgggttaccccaaaccgtaaacggaacccgtaaaccgacggtttacccacccgtaacgttaccgggaacctaaaagtttcgggtaacgtttttaaccgtttacggaaaacgttcccgggaaaccgtaccgaacccgggtccgtttacctaacgttacgttggtacgtccgaacggtaccgggtacccgtaaccccggacgtaccgtacggacgacgtcgggtaaccgttccgttaggacgtacgtacggggtacgggggtacgaacgggtacccg

SEQ ID NO: 372997 - DNA, 548 bp, Homo sapiens
  misc_feature: GZ8MTXP02FM1RA.44.74.G08.1.454.CMB.2.raw
  modified_base (276)..(276): a, c, t, g, unknown or other
  modified_base (326)..(326): a, c, t, g, unknown or other
  modified_base (337)..(337): a, c, t, g, unknown or other
  modified_base (399)..(399): a, c, t, g, unknown or other
  modified_base (406)..(406): a, c, t, g, unknown or other
  modified_base (426)..(426): a, c, t, g, unknown or other
  modified_base (442)..(442): a, c, t, g, unknown or other
  modified_base (462)..(462): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttcctgcaccggcctctggaacgtactaccagttccactacttanaccatcaactggtgcgccaggcccctggacaagggctgagtggagtgggngatcatccctntttttggctccactcacctacgcacgagcgtccggggcagatacgataccgcgacagtccanagacacngtctcatcgacaatgagttnttagaatccgacgacncggccttcactacgtgtcgngtacgacggtccccgaacccagccgtacgacgtacgtggaccgttccgttaggacgtacgcggttgggggaccacggggtaacccg

SEQ ID NO: 372998 - DNA, 678 bp, Homo sapiens
  misc_feature: GZ8MTXP02GERG8.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtcgtgggactagaatcgccgactaaccgttggtcctcggtcgtacccctttccgtcgccgaccggcctcgtaggaacgtacctacctacgttcccacttacttactaccatcaacgtggtgccgccgacggcccctggacgaaggcttggagtggagtgggtagatctacttcccgttgttttcggctccactccacctacgcacgacgtccgttccgggacagtaacttacgacgttaccggacggaacacgtacccaacgaacgacaacgtacgtcctaccaagtcgaaactaagttcgtaacggttttcctttaaagaaaccgtacccggtaacgaacccgtaccggtcccgttacttaaccgtcgttcggtacggcgtaacggtaccgggttacccccgtaaccgtacgccgttcgaccgacgtcggggtaaccttccggttaggacgtacggttccggggcgggggaccgtacggggttaacccg

SEQ ID NO: 372999 - DNA, 728 bp, Homo sapiens
  misc_feature: GZ8MTXP02IYFP7.44.74.G08.1.454.CMB.2.raw
  modified_base (205)..(205): a, c, t, g, unknown or other
  modified_base (278)..(278): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccncaaccttggtcctcggtcgtacccctttcctgcaccggcctgtggaactactacagttccactacttataccntcaactggtcgcgccacggccctggacaagggtctggagtggagttgggagtatcgtactccctttgtttcggcctccaccgtcctacctacgccaacggtacgtaccggttccggggactaagtaacgttaccgtacgttaccgggacgaacgtaacgtacccacgaacggaccaacgtaacgttcccgtaccaaacgtacggtaaaccaacgtttggtaaaccgtttttaccgtttaaagggtaaaccgttaccccgggaaccggttaacccgaaccccgggggttccttaacgttaaacccttcgtgggttacgaccgggtaacggttacccgggttaccccgtaaaccccgcggtttacgacccggtacgtacggttcggaaccgtttccggtttaaggacgtacggttccggggtacgggggacccgtaacggggtttaaccccg

SEQ ID NO: 373000 - DNA, 653 bp, Homo sapiens
  misc_feature: GZ8MTXP02FHP5Y.44.74.G08.1.454.CMB.2.raw
  modified_base (294)..(294): a, c, t, g, unknown or other
  modified_base (305)..(305): a, c, t, g, unknown or other
tcagacagtatatacacgaccggtgctcgatttagtagctctatcagggggctggggtctcaggaggcagcgctctcgggacgtctccaccatggcctgggctctgctattcctcaccctcctcactcagggcacagggtcctgggcccagtctgccctgactcagcctgcccccgtgtctgggtctcctggacagacgatcaccatcctcctgcatggaagcagcagtgacgttggtgctttaatactttgtctcctggtatacaaacaatatccaggcagacacccccaaancatctatttangatgcagtctagtccgcctcgtacggggtttacctaactcgtcttcgtcgtcggctccaacggtctacgggacctaaccgaccgggtcccttcccgtacgtaccctacgttcgtcgtcggtaccctcccgagggtcgacgggaggaacggacggtactaggtaaactttacgtaacgtcgacgagtaccctataaactaactaacgaacgaccgaacgaccgaacgtaccccttaaaccctttagtaccgttaaccggttaccgggtaaaccggttacgggaaaccgtaaccgggtacccgtaacccggtaccgttacggtacccgaaccggaccccgaaaaccccgg

SEQ ID NO: 373001 - DNA, 606 bp, Homo sapiens
  misc_feature: GZ8MTXP02IDSL4.44.74.G08.1.454.CMB.2.raw
  modified_base (241)..(241): a, c, t, g, unknown or other
  modified_base (342)..(342): a, c, t, g, unknown or other
  modified_base (386)..(386): a, c, t, g, unknown or other
  modified_base (414)..(414): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacgaggtgtccagtccctggtgcaacgtggtgcagtcgtgggactagaatcgccgcaaccgttggtcctcggtcgtaccccttttcngcacggctcgtggaagtacctaccacgttccactacttactaccatcaacgtggtcgcgccacggccccgtaggacgaaggcttgagtggagtggagatcnctccttgtttgctccactcacctcgcacgacgtccgtccggggnaagtacttacgactacgcgaacagccanacgacacgagtctacatagacatagtagtttcttagtaactccgaacgacacccgggccttactacgttacgtgtacgcgtaacggtaccggtcccctacccgagttcccacgacgtaacggttcggaaccgtttccggtttaggaacggtacgttccgggggtacgggggaccgtaacggggttaaccccg

SEQ ID NO: 373002 - DNA, 694 bp, Homo sapiens
  misc_feature: GZ8MTXP02GHVKV.44.74.G08.1.454.CMB.2.raw
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgcaaccttggtcctcggtcgtaccccttttccgtgccaccggtcctcgtaggtaactactaccagtttccaacttacttataccatcaactgggtcgcgccacggcccctaggacgaagggtcttaggagtggaggttgggtaggtaaatccgtacttcccctttgtttttacggcctacctactcctaccctacgcgaacggtacggtaccggttccggggactaaagtaaacgttaacgaacgtttacccgacgggtaacctaaacgtacccgaaacgacgaacctaaacgacgttccctaaccgaattagaaacctaaagttcgggtaaattttcccgttaagaaaacgttccgaaacgtacgacccggtacgtcttaactacgttgtacggacgaacgtaccggttaccccgacctacggccttacgcgtaacgtcggtacgtccgtttagacgtacgtcgggtcggggacgtaacgggtaaccg

SEQ ID NO: 373003 - DNA, 591 bp, Homo sapiens
  misc_feature: GZ8MTXP02HAI10.44.74.G08.1.454.CMB.2.raw
  modified_base (240)..(240): a, c, t, g, unknown or other
  modified_base (351)..(351): a, c, t, g, unknown or other
  modified_base (404)..(404): a, c, t, g, unknown or other
  modified_base (411)..(411): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtcgtgggactagaatgccgctaaccgttggtcctcggtcgtacccctttccngcaccggccttcgtggaacgtacctaccagttcccactacttataccatcaactggtcgcgccgacgccccgtggacgaagggctggagtggagtgggtgaatcatccttntttgctcactcacctacgcacgagccgtcgggcagtactacgataccgacganagtccangacacagtcaccatgaactagtgtaagtttcttaacggaaacttacccgacgacgtaccgtaccgtactaacttacgtgacggtcgaacgtacggtaccccgtaaccgcgacgttaccgctacggtcgtaacgtccgtttaggacgtacgtccgggtgggggaccgaacgggtaacccgg

SEQ ID NO: 373004 - DNA, 590 bp, Homo sapiens
  misc_feature: GZ8MTXP02HUBQC.44.74.G08.1.454.CMB.2.raw
  modified_base (241)..(241): a, c, t, g, unknown or other
  modified_base (427)..(427): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtcgcaactggtgcagtcgtgggactagaatcgccgctaaccgttggtcctcggtcgtacccctttccngccacggtcctcgtggaacgtacctaccacgttccactacttactaccatccaacgtgggtcgccgccacggccccgtaggacgacggcttggagtggagtgggtagatcactccttcgtttgctccactccactacgcacgagtccgtccgggcagtacttagacgtaccgcgaacagtcccaanacgacacgacgtcctacatcgaactatcgtagtttacttagaaactccgacgaccgacgtccgttactacgtacgtgcgtacgaacggtccggtacccgacccgagcctacgccgagtcggacttccgttagacgtcgtcgggtcgggacgtacggtaacccg

SEQ ID NO: 373005 - DNA, 571 bp, Homo sapiens
  misc_feature: GZ8MTXP02JY113.44.74.G08.1.454.CMB.2.raw
  modified_base (224)..(224): a, c, t, g, unknown or other
  modified_base (376)..(376): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtccctcggtnacccctttctgcacggcctctggaagtacctacagttccactactataccatcaactggtgcgccacggcccctggacaagggcttgagtggatgggtgaaatcatcccttcgttttgctccactcacctacgcacgagccgttccgggganagtaattacgattaccgacggacaagtccacagacacagtctccatgaacaagtgaagtttcttagaaactccgaacgacacccggtccgtactaactactgtgcgaacgtacggttccccgaccccaggtcctcgcctagtacggacgtcccgtttaggacgtacgttccgcgggggacaacggggtaaccccg

SEQ ID NO: 373006 - DNA, 643 bp, Homo sapiens
  misc_feature: GZ8MTXP02FWK4F.44.74.G08.1.454.CMB.2.raw
tcagacagtatatacacgaccggtgctcgatttagtagctctatcagggggagcatcacataacaaccacattcctcctctaaaagaagcccctgggagcacagctcatcaccatggactggacctggaggttcctctttgtggtggcagcagcaacaggtgtccagtccctggtgcaacgtggtgcagtctgggactagaatcgccgctaaccttggtcctcggtcgtacccctttctgcgaccggtcctcgtaggaacgttacctacctacgttccactacttacaccatcaacgtggtcgcgccacggccctggacgaaggtctgagtggagtgggtaggaatctacttcccttgttttcggctcctactcctacctacgtcacgacgtcgtcgggactaagtactacgtacgttaccgacggaactaacgtccacgacgacacgacgtcctacatacgaactatagtagtttacgttacgaacgttaccgaaccgtacgtaaccggtccgttacctacgtacgtcggacgtacgaacggtacccggtacccgtacccgtacgtccgtacgacgtaacgtcggacgtcccgtttaggaccggttagtaccgggtacgggggaccgtaacgggtaacccgg

SEQ ID NO: 373007 - DNA, 664 bp, Homo sapiens
  misc_feature: GZ8MTXP02GY6SA.44.74.G08.1.454.CMB.2.raw
  modified_base (286)..(286): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagatgccgcaaccttggtcctcggtcgtaccctttctgcacggcctcgtggaagtactaccagttccactacttacaccatcaacgtggngcgccaggcccctggacaggctgagtggagtggtagaatcactccttgttttggctccactcactacgcacgcgtaccgtccggggactaagtaacttacgaacgttacccgcggtaaaccaacgtcccaacgtaacgacaccgtagtaccctcccaagtcgaaaactaagtcgtaacgtttactttaacgtaaaacgttcccggaacggtaccgtaacccggggtccttaccgttaacgtacgtgggttacgacggaaacggtaccggtaccccggttaacccgacgtccgttacggacctaaggttacggggtaactcccgtttagggaccggttacgtccggggtacgggggtaccgaacggggtttaaaccccg

SEQ ID NO: 373008 - DNA, 592 bp, Homo sapiens
  misc_feature: GZ8MTXP02JAM9A.44.74.G08.1.454.CMB.2.raw
  modified_base (340)..(340): a, c, t, g, unknown or other
  modified_base (418)..(418): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaacgtactaccagttcccactacttactaccatcaacgtggtcgcgccaggcccctggacgaaggcttgagtggagtgggtgaatcactccttnttttggctccactcacctacgcacgacgtccgtccggggcaagtaacttacgattacccggacgaacaacgtcccaanacgacactagtcctccatcgaactaatgtagtttccgtttaagaaacgttcccgaacgaacccgtaacgggtcccttacgtaaccgtactggtgacgaggtaccggttccctaaccccgcgcctcgactacgtcggtactcgttgacgtcgtcgggcgggtacgacgggtaccg

SEQ ID NO: 373009 - DNA, 661 bp, Homo sapiens
  misc_feature: GZ8MTXP02G2PZB.44.74.G08.1.454.CMB.2.raw
  modified_base (240)..(240): a, c, t, g, unknown or other
  modified_base (278)..(278): a, c, t, g, unknown or other
  modified_base (324)..(324): a, c, t, g, unknown or other
  modified_base (350)..(350): a, c, t, g, unknown or other
  modified_base (444)..(444): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacgaggtgtccagtccctggtgcaacgtggtgcagtcgtgggactagaatcgccgctaaccgttggtcctcggtctacccctttcngccaccggtcctgtggaatactacagtccactacttanacatcaacgtggtgccgcaccggcccctggaccgaagggtcttagngtggagtggtgaatcacttccctttntttcggctcccactccaccgtacgcaccgacgtccggttccgggacaacgtaaacttacggtaacgttaccggacggaactaaacgtcccgaanaacggaaccacgtacgttaccctaccaacttaacggaacctaagttcggttaattttacgttaacgtaaaacctcccggtaaccggaaccgtaccgggtccctacgttactacgttgacggtaacgacggtacggtacccccgtaccctacggcctcgacgaacgttcgggtactccgttagacgtacggtcggtacgggaccgtacgggtaacccg

SEQ ID NO: 373010 - DNA, 695 bp, Homo sapiens
  misc_feature: GZ8MTXP02GEY0E.44.74.G08.1.454.CMB.2.raw
  modified_base (185)..(185): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtncagtctgggactagaatcgccgcaaccttggtccctcggtcgtacccctttctgccacggtccctcgtaggaacgtacctacacgttcccactacttataccatacaacgtggtgccgccacggcccctggacgaagggtctggagtggagtgggtagatctattcccttgtttcggctccactccacctacgcacgtcgtccgttccggggacaagtaactacgtacgttaccggacggtaaccaacggtacccaacgaacgaccctaacgacgtaccctcgaacgtgaaacctaagttaggttacgttttaccgtttaaggaaaacctcccgggtaaccggtaccgtaaccccgtcccggttacttaaccgtacggtacggttacggacgtaaccgggtacggttaccccctaccccggtacgtccacggtacctacgggttacggacgttaaccgtttaggaaggttaccggtcggggtacgggggtaccgtaaccgggggttaccc

SEQ ID NO: 373011 - DNA, 598 bp, Homo sapiens
  misc_feature: GZ8MTXP02F8XLH.44.74.G08.1.454.CMB.2.raw
  modified_base (273)..(273): a, c, t, g, unknown or other
  modified_base (287)..(287): a, c, t, g, unknown or other
  modified_base (369)..(369): a, c, t, g, unknown or other
  modified_base (379)..(379): a, c, t, g, unknown or other
  modified_base (394)..(394): a, c, t, g, unknown or other
  modified_base (410)..(410): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcgggtcgacccctttcctgcacggcctctggaagtactaccagttcactacttanaccatcaactggtncgccaggcccctggacaaggcttgagtggagtggggaggaatcacttccgtctttttcggctcccactccgactacgcacgngcttccgggnagattacgattacgngacagtccacagacanacgctccatgactaatgtagtttacgtttagaaatcccgacgtaccaccgggtcccttacctacgttaactggtcgtacggtacggtaccgggttaccccgtaaccccgcgtcccgtacgacgaccgtcggaacggttccgtttcgaacggtacgttcgggacgggggtaccgaccggggttaacccg

SEQ ID NO: 373012 - DNA, 652 bp, Homo sapiens
  misc_feature: GZ8MTXP02HD4PD.44.74.G08.1.454.CMB.2.raw
  modified_base (294)..(294): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtgcaacgtggtgcagtctgggactagatgccgcaaccgttggtcctcggtgtacccctttctgctacggcctgtaggaacgtacctactagttccacttacttataccatcaacgtggtcncgccacggcccctggacgaaggtctggagtggagtgggtagaatctacttcccgtttgttttcggccttcccgaccttccaacccgttacgcaaccggacgtcccggttaccggggactaagtaaaccttaccggtacgttaacccggccgggtaaactaacggtacccaacgaacgaccaacgaacgttcccaccattacgactaattacggtattttacgttaagtaaacgtcccgaacgtacccgacggtaccgtactaactcgtgtacgcgtaacgtaccggtccctacccgagtcccgtacgcctagtacgggactccgttgacgtacgtcggacgggaccgtacggtacccg

SEQ ID NO: 373013 - DNA, 669 bp, Homo sapiens
  misc_feature: GZ8MTXP02I28Q7.44.74.G08.1.454.CMB.2.raw
  modified_base (317)..(317): a, c, t, g, unknown or other
  modified_base (602)..(602): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtcccgtggtgcaactggtgcagtcgtgggactagaatcgccgcaaccgttggtcctcggtctacccctttcctgcctaccggccttacgtaggtaacgttacctaccctacgttcccacttacttactaacccattaccaacgtgggtacnccgcccacggccccgtggacgaaggctggagtggtagtggggtagatacacttccttgtttagcctctactcacctacgcgacgacgtccgtccggggataacgaacgttcgaacgttacccgacgggtaaccaacggttacccacaacggtaacaacgtacgtcctaccgaatacgaaactatggtaactttacgtacggtaaaacttcccgggaacgaccgtaaccggtccctataccgttacttgacgtacggacgtccggttacccgtaccccagtccccncgtccgaacggttcgaacggttccgttaggacgacggtttaccgcgggggtacgaacggtacccccg

SEQ ID NO: 373014 - DNA, 738 bp, Homo sapiens
  misc_feature: GZ8MTXP02F929M.44.74.G08.1.454.CMB.2.raw
  modified_base (175)..(175): a, c, t, g, unknown or other
  modified_base (205)..(205): a, c, t, g, unknown or other
  modified_base (235)..(235): a, c, t, g, unknown or other
  modified_base (637)..(637): a, c, t, g, unknown or other
tcagacagtatatacacgaccggtgctcgatttagtagctctatcagggggagcatcacataacaaccacattcctcctctaaagaagcccctgggagcacagctcatcaccatggactggacctggaggttcctctttgtggtggcagcagcaacaggtgtccagtccctggtncaacgtggtgcagtctgggactagatgccncaaccttggtcctcggtcgtaccctttccngccgacggtcctcgtaggaatacctaccctagttcccaactacttacacctatacaacgtgggtacgccgacccgacggcccccgttaggaaccgtaacggggtccttagggaggttagggaggttggggtaggaacttcctaacgttccccgttttagtttttcgggacctaccccgtaacccttaccctaacccttaaccggactaaccggtaacggtacccggttcccgggggactaaacggtaaacgttaccggtaaacgtttaacccgggacgggaaacctaacggtacccaacacggaaccaactacgtcctaccatacgaaaccgtagttagtatttacttaagaaacgttcccgaacgtacgacccggtaccgttctaaccgtacgttgtacgngtaaccgtacggtaccccgaccccgtagccttaccgcgtaaacggtcggacttaaccgttaggacgttacggtcgggtacgggacggtaaccggtaaccgg

SEQ ID NO: 373015 - DNA, 641 bp, Homo sapiens
  misc_feature: GZ8MTXP02HIAS1.44.74.G08.1.454.CMB.2.raw
  modified_base (333)..(333): a, c, t, g, unknown or other
tcagacagtatatacacgaccggtgctcgatttagtagctctatcagggggagacttcccttcctatgataagagaggcctggaggttcctccttagctgtgggctcagaagcagagttctggggtgtctccaccatggcctggacccctctctggctcactctcctcactctttgcatagggtctgtagtttcttctgggctgactcaggagtctgctgtgtctgtggccttgggacagacagtcaagatcacatgccacggagacagcctcgagaggcaactatgacaagctaggtaaccaacgaggaacgaccgggacacggaccccctntacttgtaccccagtgtttaacggtaaaaaccgcccgggtacccctaccggggactccccgaagacccgtacgttcctacgtcggtcctcccaccctccgaaggtaaaccaccagtccttccgtagaccatcgacgtagggacctaggaggacggtaacgagtgacggacgtaggaaccttagttagttcgacgagtcgaacggtccggggtaaacgaggttaacgtaaacgttcgtacgtttaagttcggttttacccgaccgtaaccccgggggtaaccctaacgggtacccgaacccggtttccg

SEQ ID NO: 373016 - DNA, 568 bp, Homo sapiens
  misc_feature: GZ8MTXP01B8HW5.15.87.H10.1.454.CMB.2.raw
tcagtctacgtagccacgaccggtgctcgatttagcagtactgcgttgggtttccttgttgctatttagaaggtgtccagtgtgaggtgcagttggtggagtctgggggaggcttggtccaacctgggggtccctgagactctcctgtgcagcctctggattcatctttaatagttttggatgacctgggtccgccagggtccagggaaggggctggagtgggtggccaacataaagcaagatggaagtgaagaaatactatgtggactctgtgaagggccgattcaccatctctagagacaaacgccaaagaacttactgtatctgcaaaatgaaacagcctgagaggcgaggacaccggctctgtattactgtgcgaggataccctctctgggcgggccaggtttcctacggcagtggacgtcgtggggccaagggaccacggtcaccgtctccgtcacgcctccaccaacggcccactccggtccttcccctcggccaccctcctccaacgacgcacctcgttcgggggcacgaagccggcccgtcgggcttcgccgttggtccg

SEQ ID NO: 373017 - DNA, 570 bp, Homo sapiens
  misc_feature: GZ8MTXP01A1PFS.15.87.H10.1.454.CMB.2.raw
  modified_base (230)..(230): a, c, t, g, unknown or other
  modified_base (316)..(316): a, c, t, g, unknown or other
  modified_base (357)..(357): a, c, t, g, unknown or other
  modified_base (366)..(366): a, c, t, g, unknown or other
  modified_base (454)..(454): a, c, t, g, unknown or other
  modified_base (504)..(504): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgcagggtccagggagggctggagtggtgccaanataaagcaagatggaagtgaagaaatactatgtggactctgtgaagggccattcaccatctcagagacaacgccaaagaacttacngtatctgacaaatgaacagcctgagaggcgagacacggctntgtattacngtgcgagactaccctctcgtgggcggcctaggtttccgtacggcagtggacgtcgtcggggaccgaacgggaccgacggtcaccgtcnccgtcacgcctccaccgaacggcccacgtccggtccttccccgtcggccnccctcctccaagacgcaccgtcgttcggggcacgcgccggcccgtgggcttcgccgttcggtaacg

SEQ ID NO: 373018 - DNA, 564 bp, Homo sapiens
  misc_feature: GZ8MTXP01EOLT0.15.87.H10.1.454.CMB.2.raw
  modified_base (235)..(235): a, c, t, g, unknown or other
  modified_base (366)..(366): a, c, t, g, unknown or other
  modified_base (375)..(375): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcattctttaatagtttttggatgacctgggtccgccagggtccagggaagggctggagtgggtgccaanataaagcaaagatggaagtgaagaaatactatgtggactctgtgaaggccattcacatctccagagacaaacgccaaagaacttactgtatctgacaaaatgaaacagcctgagaggcgaggacacggctntgtattacngtgcgagataccctctcgtgggcggcctaggttcctacggcagtggacgtcgtcggggccgaagggaccacggtcaccgtctccgtcacgcctccaccaacggcccatccggtcctcccctcgccaccctcctccaagacgcacctcgttcggggcacgcgcggcccgtgggcttcgccgttggtaacg

SEQ ID NO: 373019 - DNA, 597 bp, Homo sapiens
  misc_feature: GZ8MTXP01EYYDP.15.87.H10.1.454.CMB.2.raw
  modified_base (236)..(236): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcattcttttaatagtttttggatgacctgggtccgccagggtccagggaagggctggagtgggtgccaanataaagcaaagatggaagtgaagaaatactatgtggactctgtgaagggccgattcaccatctcagagacaaacgccaaagaactttactgtatctgacaaaatgaacagcctgagaggcgaggacaccggctctgtattactgtgcgaggactaccctcctcgtggggccgggtccgtacggtttcctacggcagtggacggtcgtcgggggccgaaaggggaccacggtcaccgtctcctcacgcctccaccgaacgggcccacgtccgtccttcccctcggccaccctccctccaacgacgccgacctcgttcgggggcacgcggccggcccgtcggggcttcgccgttgggtaaccg

SEQ ID NO: 373020 - DNA, 586 bp, Homo sapiens
  misc_feature: GZ8MTXP01ASK5R.15.87.H10.1.454.CMB.2.raw
  modified_base (318)..(318): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccaggggaaggggctggagtgggtggccaacataaagcaagatggaagtgagaaatactatgtggactctgtgaaggccgattcacatctcagagacaacgccaagacttacngtatctgcaaatgaacagcctgagaggcgaggacaccggctctgtattactgtgcgaggactaccctcctcgtggggcgggtcccgtacgggtttccgtacgggcagtggacgtcgtcggggaccaagggaccacggtcaccgtctcctcacgcctccaccaacgggcccagtccggtccttcccccgtcggcccacccctcctaccgacgacgccgacctcgttcgggggcaccgaacgcggcccgtgggcttcgccgttggtaacg

SEQ ID NO: 373021 - DNA, 529 bp, Homo sapiens
  misc_feature: GZ8MTXP01BZ4ZO.15.87.H10.1.454.CMB.2.raw
  modified_base (338)..(338): a, c, t, g, unknown or other
  modified_base (342)..(342): a, c, t, g, unknown or other
  modified_base (418)..(418): a, c, t, g, unknown or other
  modified_base (421)..(421): a, c, t, g, unknown or other
  modified_base (423)..(423): a, c, t, g, unknown or other
  modified_base (426)..(426): a, c, t, g, unknown or other
  modified_base (458)..(458): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagcgtggtttcgtgttaggctatttagaaggtgtcagtgtgaggtgcagttggtggagtctgggggagcttgggtccaacctggggggtccctgagactctcctgtgcagctctggattcatcttaatagttttggtatgactggtcgccaggtccgaggaggggcgtggagtggtggcgacataaganagangagtagagaaatataatgtggaatctgtgagggcggattcacatctccagagacacgaccaagaactactatattntananaanagacgagcgagagaggacgacgacgacgcgtntagtatgtgtgcgacgacgtaccgtcgttcgttcggcggtcgtcggttcgtcgcgacgtcggttcggtcgg

SEQ ID NO: 373022 - DNA, 577 bp, Homo sapiens
  misc_feature: GZ8MTXP01EVHAT.15.87.H10.1.454.CMB.2.raw
  modified_base (508)..(508): a, c, t, g, unknown or other
  modified_base (546)..(546): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccgattcacatctccagagacaaacgccaaagaacttactgtatctgcaaaatgaaacagcctgagaggcgaggacaccggctctgtattacgtgtgcgaggataccctcctcgtggggcgggcctaggtttcctacggcagtggacgtcgtggggccaagggaccacggtcaccgtctcctcacgcctaccaccgacggcccagtccggtccttcccccgtggccncccctcctccaacgcgccaccgtcgttcgggggcacgnggccggccgtgggcttcgccgttggtaaccg

SEQ ID NO: 373023 - DNA, 574 bp, Homo sapiens
  misc_feature: GZ8MTXP01C4DVA.15.87.H10.1.454.CMB.2.raw
  modified_base (363)..(363): a, c, t, g, unknown or other
  modified_base (372)..(372): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgaagaaatactatgtggactctgtgaaggccgattcacatctccagagacaacgccaaagaacttactgtatctgacaaatgaacagcctgagaggcgaggacacggctntgtattacngtgcgaggactaccctcctctgggcgggccctaggtttcctacggcagtggacgtcgtggggccaaggggaccacggtcaccgtcctccgtcagcctccaccgaacggcccatccggtccttcccccgtcggccacccctcctccaacgacgcaccgtcgttcgggggcacgcgcggcccgtgggcttgccgttggtaaccg

SEQ ID NO: 373024 - DNA, 592 bp, Homo sapiens
  misc_feature: GZ8MTXP01CJV36.15.87.H10.1.454.CMB.2.raw
  modified_base (515)..(515): a, c, t, g, unknown or other
  modified_base (535)..(535): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccaggggaaggggctggagtggggtggccaaacataaagcaaagatggaaagtgaagaaatactatgtggactctgtggaagggccattcaccatctcagagacaaacgccaaagaacttactgtatctgacaaaatgaaacagcctggagaggcgaggacaccggctctgtattacgtgtgcgagactaccctctcgtgggcgggcctacggtttcctaggcagtggacgtcgtcggggaccgaacgggaccgacggtcaccgtctccgtcacgtccctccaccgacggcccagtccgtccttccccncgccaccctcctccaagacnccgtaccgtcgttcggggccacgcggccggcccgtgggcttcgccgttcggtaaccg

SEQ ID NO: 373025 - DNA, 567 bp, Homo sapiens
  misc_feature: GZ8MTXP01EUZVZ.15.87.H10.1.454.CMB.2.raw
  modified_base (366)..(366): a, c, t, g, unknown or other
  modified_base (375)..(375): a, c, t, g, unknown or other
  modified_base (469)..(469): a, c, t, g, unknown or other
  modified_base (509)..(509): a, c, t, g, unknown or other
  modified_base (539)..(539): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaaagatggaagtgaagaaatactatgtggactctgtgaagggccgattcacatctccagagacaaacgccaaagaacttactgtatctgacaaaatgaacagcctgagaggcgaggacacggctntgtattacngtgcgaggataccctctcgtggggcggccacggtttcctacggcagtggacgtcgtggggccaacgggaccacggtcaccgtctcctcacgccnccaccgaacggcccagtccggtcctcccctcggccacccncctccaagacgccacctcgttggggcacgngcggccgtgggcttgccgttggtaaccg

SEQ ID NO: 373026 - DNA, 733 bp, Homo sapiens
  misc_feature: GZ8MTXP01CBSJR.15.87.H10.1.454.CMB.2.raw
  modified_base (234)..(234): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaagggctggagtgggtgccaanataaagcaagatggaaagtgaagaaatactatgtggactctgtgaaggccattcacatctccagagacaaacgccaaagtacttactgtaatctagacaaatgaaactagcctaggagacgggcgacggacaccggtctctagtacttacgtgtagcgaggtaactacccgttcctcggttcggggccgggtaccgtacggtttcccgtacgggctaggtcggtacggtcggtacggggaccgaacgggacccgacggtccgacccgttccttcccgtacgaccgtccctacccgaacccgaaaccgggcccctaacgttccccgggttcccctttccccccggcggtacccctcccccttaacccgtaaccccgaaacggtaccgccccgtaaacccggttccgggttaccggggggccaacccggtaaccggggccccgggtccccggttcgggggcccgttccggggtaaccccgttttcgggggtaaaaccccgg

SEQ ID NO: 373027 - DNA, 542 bp, Homo sapiens
  misc_feature: GZ8MTXP01B20TO.15.87.H10.1.454.CMB.2.raw
  modified_base (484)..(484): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcatctttaatagttttggatgacctgggtccgccagggtccagggaggggctgggagtgggtggccaacataaatcaagatggaagtgaagaaatactatgtggaactctgtgaagggccattcacatctccagagacaacgccaaagaacttactgtatctgacaaatgaacagcctagagaggcgaggacacggctctgtattctgtgnggaggactaccctcttcgttgggccggcctaggtttcccagggcagtcggaacgtcgg

SEQ ID NO: 373028 - DNA, 564 bp, Homo sapiens
  misc_feature: GZ8MTXP01A2ZVS.15.87.H10.1.454.CMB.2.raw
  modified_base (230)..(230): a, c, t, g, unknown or other
  modified_base (294)..(294): a, c, t, g, unknown or other
  modified_base (358)..(358): a, c, t, g, unknown or other
  modified_base (366)..(366): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagttttggatgacctgggtccgcagggtccagggagggctggagtggtgccaanataaagcaagatggaagtgaagaaatactatgtggactctgtgaaggccatcacatctccaganacaacgccaaagaacttactgtatctgacaaaatgaacagcctgagaggcgaggacaccggctntgtatacngtgcgagactacctctgtgggcggcagttctagcagtgacgtcgtgggacaagggacacgtcaccgtctccgtcacgcctaccaccgaacggcccactccggtccctccccgtcggcccaccctccctccaacgacgccaccgtcgttcgggggcacgaacggccggtcccgtcgggcgttcggtccgttggtaaccg

SEQ ID NO: 373029 - DNA, 588 bp, Homo sapiens
  misc_feature: GZ8MTXP01BE571.15.87.H10.1.454.CMB.2.raw
  modified_base (392)..(392): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagttttggatgacctgggtccgccagggtccagggaagggctggagtgggtggccaacataaagcaagatggaagtgaagaaatactatgtggactctgtgaagggccgattcaccatctccagagacaacgccaaagaacttactgtatctgcaaatgaacagcctgagaggcgaggacaccggctctgtattactgtgcgaggactaccctcctntcgggcgggcccaggtttcctacggcagtggacgtcgtggggccgaacgggaccgacggtcaccgtctccgtcacgcctccaccgaacggcccagtccggtccttcccccgtcggccacccctccctcccaacgacgccgaccgtcgttcgggggccacgaacggccggcccgtgggcttcgccgttcggtaaccg

SEQ ID NO: 373030 - DNA, 581 bp, Homo sapiens
  misc_feature: GZ8MTXP01EBLJE.15.87.H10.1.454.CMB.2.raw
  modified_base (236)..(236): a, c, t, g, unknown or other
  modified_base (529)..(529): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattcttttaatagtttttggatgacctgggtccgccagggtccagggaagggctggagtgggtggccaanataaagcaagatggaagtgaagaaatactatgtggactctgtgaagggccattcaccatctccagagacaaacgccaaagaacttactgtatctgacaaaatgaaacagcctaggagagggcgaaggacaccggctactgtattactgtgcgagataccctctcgtgggcgggcctaggtttccacggcagtggacgtcggtggggaccaaggggaccacgggtccaccgtctcctcacgcctaccaccgaacggcccagtccggtcctcccctgcccaccctcctcaagccnccgaccgtcggcgggcacgcggccgccgtggccgttcgtccgttcggtaacg

SEQ ID NO: 373031 - DNA, 583 bp, Homo sapiens
  misc_feature: GZ8MTXP01A97MI.15.87.H10.1.454.CMB.2.raw
  modified_base (513)..(513): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtgggggtccctgagactctcctgtgcagcctctggattcatctttaatagtttttggatgacctgggtccgcgagggtccgagggaggggctgggagtgggtgccaacataaagcaagatggaagtgaagaaatactagtgtggaacttcgtggtaggaaggggcccattccaaccatcctaccagaacgaaccaacgacccaaagtaacttactagtactctagacaaatcgaaactagcctagaaggacggcgagggacacgggctcgtgtattcgngtgcggagactacctccgttcgttgggccggtaacctcgggtttcccagggcttagtcggaaccgtcggg

SEQ ID NO: 373032 - DNA, 599 bp, Homo sapiens
  misc_feature: GZ8MTXP01BDXAI.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaaacataaagcaaagatggaagtgaagaaatactatgtggactctgtgaagggccgattcaccatctccagagacaacgccaagaacttactgtatctgcaaaatgaacagcctgagaggcgaggacaccggctctgtattactgtgcgagggtataccctcctcgtggggtcgggcccgtacgggtttccgtacgggtcaagtgggaacggtcgttcgggggccgaagggaccgacggtcaccgtcctccgtcacgcctccaccaacgggcccacgtccggtccttcccctcggccacccctcctccaacgcgccaccgtcgttcgggggcacgaacgcggcctcgggcgttcgccgttggtaaccg

SEQ ID NO: 373033 - DNA, 611 bp, Homo sapiens
  misc_feature: GZ8MTXP01A67PC.15.87.H10.1.454.CMB.2.raw
  modified_base (300)..(300): a, c, t, g, unknown or other
  modified_base (525)..(525): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccaggggaaggggctggagtgggtggccaacataaagcaaagatggaaagtgaagaaatactatgtggactctgtgaagggccattcaccatcnccagagacaacgccaaagaacttactgtatctgacaaaatgaaacagcctaggagaggcgaggacacggctctgtattactgtgcgagactaccctcctcgtcggggcggtcctaggtttcctacggcagtggacgtcgtggggccgaacgggaccacggtcaccgtctccgtcacgccctcccaccaacgggcccacgtcccggtccttcccccgtcggtcccncccctccctacccaacgacgccgaccctcgttcgggggcaccgaacggcccggcccgtcggggccttcggtcccgttcggtaaccg

SEQ ID NO: 373034 - DNA, 584 bp, Homo sapiens
  misc_feature: GZ8MTXP01BHPLH.15.87.H10.1.454.CMB.2.raw
  modified_base (321)..(321): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagttttggatgacctgggtccgccagggtccagggaagggctggagtggtgccaacataaagcaagatggaaagtgaagaaatactatgtggactctgtgaagggccattcaccatctccagagacaaacgccaaagaactttacngtatctgacaaaatgaaacagcctgagaggcgaggacacggctctgtattactgtgcgaggactaccctcctcgtgggccgggcctacggtttcctacggcagtggacgtcgtggggccgaacgggaccacggtcaccgtctccgtcacgcctccaccaacggcccacgtccggtccttccccctcggcccaccctcctccaacgacgcaccgtcgttcgggggcaccgaacgccggcccgtgggccttcgccgttggtaacc

SEQ ID NO: 373035 - DNA, 594 bp, Homo sapiens
  misc_feature: GZ8MTXP01C2GXS.15.87.H10.1.454.CMB.2.raw
  modified_base (238)..(238): a, c, t, g, unknown or other
  modified_base (371)..(371): a, c, t, g, unknown or other
  modified_base (394)..(394): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatcttttaatagtttttggatgacctgggtccgccagggtccaggggaagggctggagtggtggccaaanataaaagcaaagatggaaagtgaagaaaatactatgtggactctgtgaaggccatcacatctcagagacaaacgccaaagaacttactgtatctgacaaaatgaaacagcctgagaggcgaggacaccggctntgtatactgtgcgagatacctcncgtgggcgcagtttccacggcagtcggacgtcgtacggggaccgaaacgggaccacggtccaccgtctcctacacgccctacccgaaccgaacggcccagtccggtccttccccgcgcccaccctccctaccaagacgcctaccgtcggttcgggggccacgaacggccggcccgtgggcttcggaaccgttcggtaacg

SEQ ID NO: 373036 - DNA, 620 bp, Homo sapiens
  misc_feature: GZ8MTXP01CB2Y3.15.87.H10.1.454.CMB.2.raw
  modified_base (237)..(237): a, c, t, g, unknown or other
  modified_base (278)..(278): a, c, t, g, unknown or other
  modified_base (299)..(299): a, c, t, g, unknown or other
  modified_base (343)..(343): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatcttttaatagtttttggatgacctgggtccgccagggtccaggggaaggggctggagtgggtggccaanataaagcaaagatggaaagtgaagaaatactatgtggactntgtgaaggccattcaccatcnccagagacaacgccaaagaacttactgtatctgacaaatgaacngcctgagaggcgaggacaccggctctgtattacgtgtgcggaggtactaccctccgtcgtcggggccgggacccgtacgggtttcctacgggcgagtgggacggtcgtcggggaccgaacgggaccgacggtccaccgtcctccgtcacgccctacccgaccgaacggcccacgttccggtccttcccccgtcggcccacccctccctaccaacgacgccgaccgtcgcgggggcaccgaacggccggtccgtcgggcgttcgtccgttggtaaccg

SEQ ID NO: 373037 - DNA, 578 bp, Homo sapiens
  misc_feature: GZ8MTXP01DULN5.15.87.H10.1.454.CMB.2.raw
  modified_base (327)..(327): a, c, t, g, unknown or other
  modified_base (372)..(372): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccaggggaaggggctggagtggggtggccaaacataaagcaaagatggaaagtgaagaaatactatgtggactctgtgaagggccattcaccatctccagagacaacgccaaagaacttacngtatctgacaaaatgaacagcctagagaggcgaggacaccggctntgtattactgtgcgaggactaccctcctcgtgggcgggcctaggtttccacgggcagtggacgtcgtcggggccgaaacgggaccacggtacaccgtctcctcacgcctaccaccgaacggcccatccggtccttcccctggccaccctcctccaagacgcgaccgtcgcggggcacgcgcggccgtgggcttgccgttggtaacg

SEQ ID NO: 373038 - DNA, 590 bp, Homo sapiens
  misc_feature: GZ8MTXP01DTJVQ.15.87.H10.1.454.CMB.2.raw
  modified_base (236)..(236): a, c, t, g, unknown or other
  modified_base (277)..(277): a, c, t, g, unknown or other
  modified_base (292)..(292): a, c, t, g, unknown or other
  modified_base (365)..(365): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcattctttaatagtttttggatgacctgggtccgccagggtccagggaagggctggagtgggtgccaaanataaagcaagatggaagtgaagaaatactatgtgactctgngaaggcatcacatcncagagacaacgccaaagacttactgtatctgacaaatgaacagctgagaggcgagacacggctctgtattacngtgcgagactaccctcctgtgggccgggcctacggtttccgtacggcagtcggacgtcggtcggggaccgaacgggaccgaccggtccaccgtcctcctcacgccctacccgaccgaaccgggcccacgtccggtcccttcccccgtcggccctacccctccctaccaacgacgccaccgtcgcggggcacgcgccggccgtcggccttcgtccgttggtaaccg

SEQ ID NO: 373039 - DNA, 611 bp, Homo sapiens
  misc_feature: GZ8MTXP01C2DW5.15.87.H10.1.454.CMB.2.raw
  modified_base (235)..(235): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatcttttaatagtttttggatgacctgggtccgccagggtccagggaagggctggagtgggtggccaanataaagcaaagatggaaagtgaagaaatactatgtggactctgtgaagggccgattcaccatctccagagacaacgccaaagaacttactgtatctgacaaaatgaaacagcctgagaggcgaggacacggctctgtattactgtgcgagataccctctcgtgggcggcctacggtttccacggcagtggacgtcgtcggggccaaacgggaccacgtcaccgtcctcctcacgccctaccaccgaaacgggcccacgtccggtcccttcccccgtcggcccacccctccctacccaaacggacgcctaacccgtcgttcgggggccaccgaacggcccggccccgttcggggccttcggtcccgttcggtaaccg

SEQ ID NO: 373040 - DNA, 610 bp, Homo sapiens
  misc_feature: GZ8MTXP01EHYDH.15.87.H10.1.454.CMB.2.raw
  modified_base (297)..(297): a, c, t, g, unknown or other
  modified_base (367)..(367): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccagggtccagggaaggggctggagtgggtggccaacataaagcaagatggaagtgaagaaatactatgtggactctgtgaagggccattcaccatcncagagacaaacgccaaagaacttactgtatctgacaaaatgaaacagcctgagaggcgaggacacggctntgtattactgtgcgaggtactaccctcctcgtggggccgggtcctacggtttcctacggcagtggacgtcgtcggggaccgaacgggaccgacgtcaccgtcctccgtcacgccctaccaccgaacgggcccacgttccggtcccttcccccgtcggcccaccctccctaccaagacgccaccgtcggttcgggggccaacgcggcccggcccgtcggggccttcggtccgttcgggtaaccg

SEQ ID NO: 373041 - DNA, 582 bp, Homo sapiens
  misc_feature: GZ8MTXP01EBT0W.15.87.H10.1.454.CMB.2.raw
  modified_base (379)..(379): a, c, t, g, unknown or other
  modified_base (550)..(550): a, c, t, g, unknown or other
  modified_base (566)..(566): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaaagatggaaagtgaagaaatactatgtggactctgtgaagggccgattcaccatctccagagacaacgccaaagaacttactgtatctgacaaaatgaaacagcctgagaggcgaggacaccggctctgtattacngtgcgaggactaccctcctcgtggggccgggtcctacggtttcctacggcagtggacgtcgtcggggccaagggaccacggcaccgtctcctcacgcctccaccaacggcccacgtccggtcctcccctcggccaccctcctccaacgacgcacctcgttcgggggcacgngccggcccgtcgggcncgtccgttggtaaccg

SEQ ID NO: 373042 - DNA, 573 bp, Homo sapiens
  misc_feature: GZ8MTXP01D60V1.15.87.H10.1.454.CMB.2.raw
  modified_base (233)..(233): a, c, t, g, unknown or other
  modified_base (321)..(321): a, c, t, g, unknown or other
  modified_base (364)..(364): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtgccaanataaagcaaagatggaaagtgaagaaatactatgtggactctgtgaagggccatcaccatctcagagacaaacgccaaagaacttacngtaatctgacaaatgaacagcctgagaggcgaggacacggctntgtatactgagcgaggtactaccctcctcgtcggggcgggtcctaggtttcctacggcagtggacgtcgtggggccaagggaccacggcaccgtctccgtcacgcctccaaccaacggcccacgtccggtccttccccgtcggccaccctccctacaacgacgcacctcgcggggcacgaagcgccgtcgggcttcgtccgttgtaacg

SEQ ID NO: 373043 - DNA, 593 bp, Homo sapiens
  misc_feature: GZ8MTXP01DGKRH.15.87.H10.1.454.CMB.2.raw
  modified_base (377)..(377): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgacctgggtccgccagggtccaggggaagggctggagtgggtggccaacataaagcaaagatggaagtgaagaaatactatgtggactctgtgaagggccattcaccatctccagagacaacgccaaagacttactgtatctgacaaatgaacagcctgagaggcgaggacacggctctgtattacngtgcgagactaccctcctctgggcgggctacgtttcctacggcagtggacgtcgtcggggccgaacgggaccacggtcaccgtcctccgtcacgcctcccaccgaacgggcccacgtccggtcccttcccccgtcggcccacccctcctcccaagcgccgaccgtcgttcgggggcacgaacggccggccgtcgggcttcgtccgttcggtaaccg

SEQ ID NO: 373044 - DNA, 577 bp, Homo sapiens
  misc_feature: GZ8MTXP01CF4Q7.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaaagatggaagtgaagaaatactatgtggactctgtgaagggccgattcacatctccagagacaacgccaaagaacttactgtatctgcaaatgaacagcctgagaggcgaggacaccggctctgtattactgtgcgagatacctcctctgggcgggccaggtttccacggcagtggacgtcgtggggccaagggaccacggtcaccgtctccgtcacgccctccaccgaacgggcccacgtccggtcctcccctggccacccctcctccaacgacgcaccctcgttcgggggcacgaacggccggcccgtggggcttcggaaccgttggtaaccg

SEQ ID NO: 373045 - DNA, 612 bp, Homo sapiens
  misc_feature: GZ8MTXP01CLQSE.15.87.H10.1.454.CMB.2.raw
  modified_base (239)..(239): a, c, t, g, unknown or other
  modified_base (346)..(346): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtgggggggtccctgagactctcctgtgcagcctctggattcatctttaatagtttttggatgacctgggtccgccagggtccaggggaaggggctggagtgggtggccaaanataaagcaaagatggaagtgaagaaatactatgtggactctgtgaagggccattcacatctccagagacaacgccaaagaacttactgtatctgacaaaatgaaacngcctggagaggcgaggacaccggctctgtattactgtgcgaggactaccctcctcgtcggggcgggccgtacggtttccgtacggcagtggacggtcgtcggggaccgaacgggaccgacggtcaccgtctccgtcacgcctaccaaccgaacgggcccacgtccgtccttcccccgtcggtcccacccctccctaccaacgacgccgaccgtcgttcgggggccacgaacggccggcccgtgggccttcggtccgttggtaaccg

SEQ ID NO: 373046 - DNA, 614 bp, Homo sapiens
  misc_feature: GZ8MTXP01A6SPA.15.87.H10.1.454.CMB.2.raw
  modified_base (237)..(237): a, c, t, g, unknown or other
  modified_base (328)..(328): a, c, t, g, unknown or other
  modified_base (370)..(370): a, c, t, g, unknown or other
  modified_base (533)..(533): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattcttttaatagtttttggatgacctgggtccgccagggtccaggggaagggctggagtgggtggccaanataaagcaagatggaaagtgaagaaatactatgtggactctgtgaagggccgattcaccatctccagagacaaacgccaaagaactttacngtatctgacaaatgaacagctagagaggcgaggacacggctntgtattactgtgcgagactaccctcctcgtcgggccgggtcctacggtttcccgtacggcagtcggacgtcggtcggggaccgaacgggaccgacggtccaccgtcctcctcacgccctaccaccgacggccctacgtcccggtcccttcccccgtcggcccncccctccctcccaacgccgccgacccgtcggttcgggggccacgaacggccggcccgtcgggcgttcgccgttggtaaccg

SEQ ID NO: 373047 - DNA, 603 bp, Homo sapiens
  misc_feature: GZ8MTXP01EKFMS.15.87.H10.1.454.CMB.2.raw
  modified_base (280)..(280): a, c, t, g, unknown or other
  modified_base (297)..(297): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccagggtccagggaaggggctggagtgggtgccaaacataaagcaaagatggaaagtgaagaaatactatgtggactctgngaaggccattcacatcncagagacaaacgccaaagaacttactgtatctgacaaaatgaaacagcctgagaggcgaggacacggctctgtattactgtgcgagacttaccctcctgtgggcgggcctacggttctacggcagtggacgtcgtggggaccgaagggaccacggtcaccgtctccgtcacgccctaccgaaccgaaacgggcccctacgtccggttcccttcccccgtcggcccacccctccctaccaaacgcgccaaccgtcgcgggggccaccgaacggccgcccgtcgggcgttcgtcccgttgggtaaccg

SEQ ID NO: 373048 - DNA, 616 bp, Homo sapiens
  misc_feature: GZ8MTXP01BQB6P.15.87.H10.1.454.CMB.2.raw
  modified_base (366)..(366): a, c, t, g, unknown or other
  modified_base (538)..(538): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccaggggaaggggctggagtgggtggccaacataaagcaagatggaagtgaagaaatactatgtggactctgtgaagggccgattcaccatctccagagacaacgccaaagaacttactgtatctgacaaatgaacagcctgagaggcgaggacacggctntgtattactgtgcgaggactaccctcctcgtggggccgggcccgtacgggtttcccgtacggcagtgggacggttacgtcgggggaccaacggggacccgacgggtccaccgtcctccgtcacgccctccaccgaacgggcccacgttccggtcccttcccccgtcggcccnccccgtccctccaaacgcgccgaccgtcgttcgggggccacgaacgccggcccgtgggccttcgcccgttggtaaccg

SEQ ID NO: 373049 - DNA, 571 bp, Homo sapiens
  misc_feature: GZ8MTXP01BYDHI.15.87.H10.1.454.CMB.2.raw
  modified_base (318)..(318): a, c, t, g, unknown or other
  modified_base (541)..(541): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtggtggccaacataaagcaagatggaagtgaagaaatactatgtggactctgtgaagggccattcacatctcagagacaacgccaaagaacttacngtatctgacaaatgaacagcctgagaggcgaggacaccggctctgtattactgtgcgaggactacctcctcgtgggcgggcctaggtttcctacggcagtggacgtcgtggggccaacgggaccacggtcaccgtctccgtcacgccctaccaccgaacgggcccacgtccggtccttccccctggccaccctcctccaagcgcacctcgttcgggggcacgngccggccgtgggcttcgccgttggtaaccg

SEQ ID NO: 373050 - DNA, 606 bp, Homo sapiens
  misc_feature: GZ8MTXP01DANKI.15.87.H10.1.454.CMB.2.raw
  modified_base (237)..(237): a, c, t, g, unknown or other
  modified_base (275)..(275): a, c, t, g, unknown or other
  modified_base (294)..(294): a, c, t, g, unknown or other
  modified_base (318)..(318): a, c, t, g, unknown or other
  modified_base (530)..(530): a, c, t, g, unknown or other
  modified_base (546)..(546): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgacctgggtccgccagggtccagggaagggctggagtgggtgccaanataaagcaagatggaagtgaagaaatactatgtgactntgtgaaggccatcacatcncagagacaacgccaagaacttacngtatctgacaaaatgaaacagcctgagaggcgaggacaccggctctgtattactgtgcgaggacttacccgtcctcggtcggggcgggcccgtacggtttcccgtacggcagtgggtacggtcgtcgggggaccgaacgggacccgacggtccgacccgtctcctcacgccctaccaccgaaccggcccactccggtccttccccgtcgccncccctcctccaacgcnccgaccgtcggttcgggggcacgcggccggcccgtcgggcgttcgtccgttcggtaaccg

SEQ ID NO: 373051 - DNA, 586 bp, Homo sapiens
  misc_feature: GZ8MTXP01D3M9J.15.87.H10.1.454.CMB.2.raw
  modified_base (380)..(380): a, c, t, g, unknown or other
  modified_base (391)..(391): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaacgtggggggtccctgagactctcctgtgcagcctctggattcattctttaatagtttttggatgacctgggtccgccgagggtccgaggggaaggggctgggaggtgggtgaccaaacataaagcaaagataggaagtgaacgaaatanagtgtgaactntggtgaagggcattcacatctcagacgaacaacgaccaaagtaaacttactagtatctagacaaatcgaaacagcctaggagagacgaggacacggctctagttacttcgtggtgacgaggttactacccgtcgttcggttgggacccggtccgtaagggtttccctacggggcttaggtcggttaacgtccggg

SEQ ID NO: 373052 - DNA, 593 bp, Homo sapiens
  misc_feature: GZ8MTXP01D04LA.15.87.H10.1.454.CMB.2.raw
tcagtctacgtagccacgaccggtgctcgatttagcagtactgcgttgggtttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgccagggtccagggaagggctggagtgggtggccaacataaagcaagatggaagtgaagaaatactatgtggactctgtgaagggccattcaccatctccagaagacaaacgccaaagaacttactgtatctgacaaatgaacagcctgagaggcgaggacaccggctctgtattactgtgcgaggactaccctctcgtgggtcgggccctaggtttcctacggcagtggacgtcgtggggaccaagggaccacggtcaccgtctccgtcacgccctccaccgacgggcccacgtccgtccttccccgcggcccacccctccctccaacgcgctacccgtcgttcgggggccacgcggccggcccgtcggggcttcggcccgttgggtaaccg

SEQ ID NO: 373053 - DNA, 610 bp, Homo sapiens
  misc_feature: GZ8MTXP01CS8X1.15.87.H10.1.454.CMB.2.raw
  modified_base (337)..(337): a, c, t, g, unknown or other
  modified_base (344)..(344): a, c, t, g, unknown or other
  modified_base (517)..(517): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggtttccttgttgctattttagaaggtgtccagtgtgaggtgcagttggtggagtcgtgggggagcttggtccaacgtggggggtccctgagactctcctgtgcagcctcgtggattcattctttaatagtttttggatgacctgggtccgccgagggtccgagggaggggctgggagtgggngaccaanaataaagcaaagataggaaagtgaaagaaatatatggtaggaacttcgtggtagaaaggggccgtattcacatccaccagaacaacaaacgaccaaagaaacttactgtaattcagaacaaaatggaaacagacctggaaggaggcgaaggacacggtctacgtgtacttagnggtgacggtagacttacccgccgttacggttgggcccgggtaaccctagggttttccccaacgggtccgttagttcggggaaccgtttcgggg

SEQ ID NO: 373054 - DNA, 707 bp, Homo sapiens
  misc_feature: GZ8MTXP01EQ885.15.87.H10.1.454.CMB.2.raw
  modified_base (230)..(230): a, c, t, g, unknown or other
  modified_base (236)..(236): a, c, t, g, unknown or other
  modified_base (296)..(296): a, c, t, g, unknown or other
  modified_base (344)..(344): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgacctgggtccgccagggtccagggaagggctggagtggngccaanataaagcaagatggaagtgaagaaatactatgtggactctgtgaaggccattcaccatcncagagacaaacgccaaagaacttactgtaatctagacaaaatgaaacngcctggaagaggcggaacgacgaccggtcttacgtgttaacttacgtggtgccggaaggtacttacccgtccgtcggtcggggccggtaccgtacgggttttaccgaacggcagtacgggaccgttacgggacggggaaccgaaacggggaccgtaccggtcctaaccgtccttccacgaccgtccccacccgaaaccggaaccggtcccctacgttcccggttcccctccccggtcggacccctaccccctcccgaaccgaaaggaccgacccgtaccggttccggggcgggggacccaaaccggtccgggccccggcccggttcgggggacccttcgggcccgtttaacgggtaaacccgg

SEQ ID NO: 373055 - DNA, 558 bp, Homo sapiens
  misc_feature: GZ8MTXP01BI2X7.15.87.H10.1.454.CMB.2.raw
  modified_base (328)..(328): a, c, t, g, unknown or other
  modified_base (334)..(334): a, c, t, g, unknown or other
  modified_base (398)..(398): a, c, t, g, unknown or other
  modified_base (426)..(426): a, c, t, g, unknown or other
  modified_base (429)..(429): a, c, t, g, unknown or other
  modified_base (431)..(431): a, c, t, g, unknown or other
  modified_base (434)..(434): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagcgtggtttcgtgtaggctatttagaaggtgtcagtgtgaggtgcagttggtggagtcgtgggggagcgttggtccaaccgtgggggtccctgagactctcctgtgcagcctctggattcatcttaatagttttggattgacctgggtccgcgagggtccagggagggctggagtggngccaanataaagcaagatgaagtgaacgaaatatagtgtcggaactgtgtgaaagggccattcaccatcncagacacaacgccaaataccttatgtantananaanagacgacgacgagagagagacgacgacgtcgtctagtacgttagtgtgacgtacgttacgtaccgtccgttcgttcggttccggtccgtacggttccgtacggtcgttacgtcggttcggtcgg

SEQ ID NO: 373056 - DNA, 599 bp, Homo sapiens
  misc_feature: GZ8MTXP01BXQ4P.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccagggtccagggaaggggctggagtgggtggccaacataaagcaagatggaagtgaagaaatactatgtggactctgtgaagggccgattcaccatctccagagacaaacgccaaagaacttactgtatctgacaaaatgaaacagcctagagaggcgaggacaccggctctgtatactgtgcgaggataccctctcgtgggcgggcctaggtttccacggcagtggacgtcgtcggggccaacgggaccacgtcaccgtcctccgtcacgcctcccaaccgaacgggcccacgtccggtcccttcccccgtcggcccaccctccctccaacgacgccgacccgtcgttcgggggccacgaacggccggcccgtgggccttcggtcccgttggtaaccg

SEQ ID NO: 373057 - DNA, 542 bp, Homo sapiens
  misc_feature: GZ8MTXP01B9TNX.15.87.H10.1.454.CMB.2.raw
  modified_base (448)..(448): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtctgggggaggcttggtccaaccgtggggggtccctgagactctcctgtgcagcctctggattcatctttaatagtttttggatgacctgggtccgccgagggtccagggaggggctggagtgggtgccaacataaagcaagatggaagtgaagaaatactatgtggaactctggtgaagggccgatcaccatctccagagacaacgccaaagaacttactgtatctgacaaatgaacngcctagagaggcgaggacacggctctgtatactgtgcgaggactaccgtcttcgttggccgggtcctgggtttcccaggcagtcggaacgtcgg

SEQ ID NO: 373058 - DNA, 585 bp, Homo sapiens
  misc_feature: GZ8MTXP01B85T6.15.87.H10.1.454.CMB.2.raw
  modified_base (303)..(303): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatctttaatagtttttggatgacctgggtccgccagggtccagggaagggctggagtgggtggccaacataaagcaagatggaagtgaagaaatactatgtggactctgtgaagggccgattcaccatctccaganacaacgccaaagaacttactgtaatctgacaaatgaacagcctgagaggcgaggacaccggctctgtattactgtgcgaggactacctcctcgtgggcgggccacggtttcctacggcagtggacgtcgtggggccaaggggaccacgtcaccgtcctcctcacgccctccaccgaacggcccagtccggtccttcccccgtcggcccacccctccctaccaacgacgccgaccgtcgttcgggggcacgcgcggcccgtcgggcttcgccgttcggtaacg

SEQ ID NO: 373059 - DNA, 633 bp, Homo sapiens
  misc_feature: GZ8MTXP01DGZ4D.15.87.H10.1.454.CMB.2.raw
  modified_base (298)..(298): a, c, t, g, unknown or other
  modified_base (344)..(344): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcatctttaatagtttttggatgacctgggtccgccagggtccaggggaagggctggagtggggtggccaaacataaagcaaagatggaagtgagaaatactatgtgactctgtgaagggccattcacatcnccagagacaacgccaaagaacttactgtatctgacaaaatgaaacngcctgagaggcgaggacaccggctcgtgtattacgtgtgcgagtactaccctctcgtgggccggctacggtttcctacggcagtcggacgtcggtcggggaccgaacggggacccacggtccaaccggttcctccgtaccgacgcccctacccgaaccgaaccgggcccctacgttcccggtcccttcccccgtcggcccaaccccgtccctaccgaacgcgaccgtaccgtcggttcgggggccacgaacggcccggcccgtcgggccgttcgtccgttcggtaaccg

SEQ ID NO: 373060 - DNA, 585 bp, Homo sapiens
  misc_feature: GZ8MTXP01B9VLC.15.87.H10.1.454.CMB.2.raw
  modified_base (304)..(304): a, c, t, g, unknown or other
  modified_base (329)..(329): a, c, t, g, unknown or other
  modified_base (336)..(336): a, c, t, g, unknown or other
  modified_base (464)..(464): a, c, t, g, unknown or other
  modified_base (497)..(497): a, c, t, g, unknown or other
tcagtctacgtagccacgaccggtgctcgatttagcagtactgcgttggggtttgggggtctcagagaggagccttagccctggactccaaggcctttccacttggtgatcagcactgagcacagaggactcaccatggaattgggactgagcttgggttttccttgttgcttatttagaaggtgtccagtgtgaggtgcagttggtggagtcgtgggggagtcttggtccgaacgtggggggtccctgagactctcctgtgcagcctctggattcatctttaatgttttgatgactgggtccncgaggtcagggagggctggagtggngaccaanataaagcaaagataggaagtgaagaaatactagtgtggaaactcgtgtgaaacgggcctagttccaccagtcctacaagacgaacaacgaccaaagtaacttacgtgtaactctagacaaatcgaacncgtcctaggacggagggcgaaggacgtaccggnttccgtagttactacgtgtggccgtaaggactaccctcgttcgttgggccggtcctaggtttccaacggcttagtgggaacgtccggg

SEQ ID NO: 373061 - DNA, 618 bp, Homo sapiens
  misc_feature: GZ8MTXP01EJ94X.15.87.H10.1.454.CMB.2.raw
  modified_base (238)..(238): a, c, t, g, unknown or other
  modified_base (299)..(299): a, c, t, g, unknown or other
  modified_base (325)..(325): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcattctttaatagtttttggatgacctgggtccgccagggtccagggaaggggctggagtgggtggccaaanataaagcaaagatggaagtgaagaaatactatgtggactctgtgaagggccattcacatcncagagacaaacgccaaagaacttacngtaatctagacaaatgaaacagcctgagaggcgaggacacggctctagtattacgtgtgcggaagtctaccctccgtcgtggggccgggtaccgtacggtttccgtacggcagtcggacgttcgtacggggaccaacgggaccacggtcaccgtctcctcacgcctaccgaccgaacggcccactccggtcctccccctcggccctcccctcctcccgaaagacgccgaacccgttcggcgggggccacgaacggtcccggcccgttcggggccttcgcccgttcggtaaccg

SEQ ID NO: 373062 - DNA, 591 bp, Homo sapiens
  misc_feature: GZ8MTXP01DQBQ4.15.87.H10.1.454.CMB.2.raw
  modified_base (235)..(235): a, c, t, g, unknown or other
  modified_base (345)..(345): a, c, t, g, unknown or other
  modified_base (379)..(379): a, c, t, g, unknown or other
  modified_base (522)..(522): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcattctttaatagtttttggatgacctgggtccgccagggtccagggaagggctggagtgggtgccaanataaagcaaagatggaagtgaagaaatactatgtggactctgtgaagggccattcaccatctccagaagacaaacgccaaagaacttactgtatctgacaaaatgaaacngcctgagaggcgaggacaccggctctgtattacngtgcgaggactaccctcctcgtgggcgggtcctacggtttccgtacggcgagtggacgtcgtcggggaccgaacgggaccgacggtcaccgtcctcctcacgcctaccaccgaacggcccagtccggtccttcccctggcccnccctcctaccaacgcgcgaccgtcgttcgggggcacgcggccgccgtgggcttcgtccgttggtaaccg

SEQ ID NO: 373063 - DNA, 655 bp, Homo sapiens
  misc_feature: GZ8MTXP01CWCGI.15.87.H10.1.454.CMB.2.raw
  modified_base (240)..(240): a, c, t, g, unknown or other
  modified_base (335)..(335): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattcttttaatagtttttggatgacctgggtccgccagggtccaggggaagggctggagtggggtgccaaanataaaagcaaagatgggaagtgaagaaaatactatgtggactctgtgaagggccattcaccatctaccagacgacaaacgccaaagaactttacngtatctgacaaaatgaaacagcctggagaggacgaggacaccggctctgtattactggtgcgaaggacttaccctcctcgtcggggcgggccgtacggtttccgtacggctagtcgggacggtcgtacgggggaccgaaacggggaccgacggtccaccgtcctcctccgacgtccctacccgaaccgaaccgggcccacgtccgggtcccttccccgtcggcccacccctccctaccgaaacgaccgccgtacccgtcggttacgggggcaccgaacgggcccggcccgtcgggccgttcggtcccgttcggtaaccgg

SEQ ID NO: 373064 - DNA, 603 bp, Homo sapiens
  misc_feature: GZ8MTXP01A9Y6C.15.87.H10.1.454.CMB.2.raw
  modified_base (302)..(302): a, c, t, g, unknown or other
  modified_base (374)..(374): a, c, t, g, unknown or other
  modified_base (587)..(587): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaagggctggagtgggtggccaacataaagcaagatggaagtgaagaaatactatgtggactctgtgaagggccattcaccatctccaganacaacgccaaagaacttactgtatctgacaaaatgaacagcctgagaggcgaggacacggctctgtattacngtgcgaggactaccctcctcgtgggcgggcccgtaggtttcctacggcagtgggacgtcgtcggggaccgaacgggaccacggtcaccgtcctccgtcacgccctaccgacccgaacggggccccacgtccggtcccttcccccgtcggcccacccctccctaccaacgacgccacccgtcgttcgggggccacgaacgccggcccgtgggcncgtccgttggtaaccg

SEQ ID NO: 373065 - DNA, 723 bp, Homo sapiens
  misc_feature: GZ8MTXP01B17KG.15.87.H10.1.454.CMB.2.raw
  modified_base (235)..(235): a, c, t, g, unknown or other
  modified_base (274)..(274): a, c, t, g, unknown or other
  modified_base (321)..(321): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattctttaatagtttttggatgacctgggtccgccagggtccagggaagggctggagtggtgccaanataaagcaagatggaagtgaagaaatactatgtggactntgtgaaggccatcaccatctcagacgacaaacgccaaagaacttacngtatctgacaaaatgaaacagcctgagaggcgaggacacggctctgtattctagtgcgaggactaccctcctcgtcggggccgggtaccgtacggtttcccgtacgggcacggtacggtacggtacggtcgggggacccgaaacgggggaccccgaccgggtacccgtaacccgttcccttcccggtaccgtaccgtccccgttaccccgaacccgaaaccggggcccctaacgttccccggttccccgtttcccccccgtccgggtcccctacccccgttcccctaacccaaacggtacgaccccgtaacccgttccgggttacggggggcccaaccggaacccgggcccgggtcccccgttcgggggcccgttaccgggtcccgttcgggtaaccccggg

SEQ ID NO: 373066 - DNA, 600 bp, Homo sapiens
  misc_feature: GZ8MTXP01EJ95H.15.87.H10.1.454.CMB.2.raw
  modified_base (299)..(299): a, c, t, g, unknown or other
  modified_base (325)..(325): a, c, t, g, unknown or other
  modified_base (569)..(569): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccaggggaaggggctggagtgggtggccaaacataaaagcaaagatggaaagtgaagaaatactatgtggactctgtgaaggccatcacatcnccagagacaacgccaaagaacttacngtatctgacaaaatgaaacagctagagaggcgaaggacaccggctactgtaattacgtgtgcgaggtactacccgtcctcgtgggccgggtcctaggtttccacgggcagtgggacgtcgtcggggaccaacggggaccacgggccaccgtctccgtcacgcccctaccgaccgaacgggccctacgtccggtccctccccgtgcccaccctcctaccaagcgccaccgtcgttcggggcacgnggccgccgtgggccttcggcccttggaaccg

SEQ ID NO: 373067 - DNA, 578 bp, Homo sapiens
  misc_feature: GZ8MTXP01CNWZH.15.87.H10.1.454.CMB.2.raw
  modified_base (394)..(394): a, c, t, g, unknown or other
  modified_base (510)..(510): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatcttttaatagtttttggatgacctgggtccgccagggtccagggaagggctggagtgggtgccaacataaagcaaagatggaagtgaagaaatactatgtggactctgtgaagggccgattcacatctccagagacaaacgccaaagaacttactgtatctgacaaaatgaacagcctgagaggcgaggacaccggctctgtattactgtgcgaggatacctcctntcgggcgggcctaggttcctacggcagtggacgtcgtcggggaccaagggaccacgtcaccgtctcctcacgcctccgaaccaacgggcccactccgtccttcccccgtcggcccncccctcctaccaacgacgcaccgtcgttcgggggcacgaacgcgccctgggcttcgccgttggtaacg

SEQ ID NO: 373068 - DNA, 726 bp, Homo sapiens
  misc_feature: GZ8MTXP01AHLA7.15.87.H10.1.454.CMB.2.raw
  modified_base (304)..(304): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtgggggtccctgagactctcctgtgcagcctctggattcatctttaatgtttttggatgacctgggtccnccgagggtccgaggggaaggggctggagtgggtgaccaacataaagcaagataggaagtgaagaaatactatgtggtaactcgtggtaggaaacggggcccgtatttccgaacctattccctacccgaaggaacgaaccaaaccggacccaaaacggtaaacctttaaccgtaggttaactaccgttagaacctaaaagttcggaaaacctacggtaccccgtagggaaacgggaacgggggaccggaacgggaaccgaaccggggtccttaccgttaggttaactttaccgtgggttacggaccggtaaagggttaccttaaccccggttcccttcggttcggggggcccgggtaacccggttacggggtttttccccgaacggggccgttaaggttcggggaacccgggtttcccggggg

SEQ ID NO: 373069 - DNA, 588 bp, Homo sapiens
  misc_feature: GZ8MTXP01A5BXN.15.87.H10.1.454.CMB.2.raw
  modified_base (235)..(235): a, c, t, g, unknown or other
  modified_base (370)..(370): a, c, t, g, unknown or other
  modified_base (379)..(379): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccaggggaagggctggagtgggtgccaanataaagcaaagatggaaagtgaagaaatctatgtggactctgtgaagggccattcaccatctccagagacaaacgccaaagaactttactgtatctgacaaaatgaaacagcctgagaggcgaggacaccggctntgtattacngtgcgaggactaccctcctgtcgggcggtcctaggttcctacggcagtcggacgtcgtcggggaccgaacgggaccgacggtcaccgtctccgtcacgcctaccaccgacggcccacgtccggtcctccccgtcggccaccctccaccacgacgcgaccgtcgttcgggggcacgcggccggccgtcgggcgttcgccgttcggtaacg

SEQ ID NO: 373070 - DNA, 646 bp, Homo sapiens
  misc_feature: GZ8MTXP01D6JLS.15.87.H10.1.454.CMB.2.raw
  modified_base (236)..(236): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaaggggctggagtgggtggccaanataaagcaagatggaagtgaagaaatactatgtggactctgtgaagggccgattcaccatctcagagacaacgcaagaactactgtatctgacaaatgaacagcctgagaggcgaggacaccggctcgtagtattacgtgtcgcggagacttaccctcctcggtcggggcgggtccgtacgggtttccgtacggcagtcggacggtcggtcggggaccgaacgggaccgacggtaccgacccgttcctcccgtacgaccgtccctaccccgaaccgaaccggggcccctaccgttcccggttcccgttcccccgtcggcccctacccctcccctaccgaaacgcgaccgtacccgttcggcgggggccacgaacggccggcccggtcggccgttcgcccgttggtaaccg

SEQ ID NO: 373071 - DNA, 577 bp, Homo sapiens
  misc_feature: GZ8MTXP01DSHYT.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaaacgccaaagaacttactgtatctgacaaaatgaacagcctgagaggcgaggacacggctctgtattactgtgcgaggactaccctcctcgtgggcgggcctacggtttcctacggcagtggacgtcgtcggggccaacgggaccacggtcaccgtctctcacgcctccaccaacggccatccggtccttccccgtcggccacccgtcctccaacgacgccaccgtcgttcgggggcacgcggcggcccgtgggcttcgtccgttggtaacg

SEQ ID NO: 373072 - DNA, 615 bp, Homo sapiens
  misc_feature: GZ8MTXP01BGD95.15.87.H10.1.454.CMB.2.raw
  modified_base (235)..(235): a, c, t, g, unknown or other
  modified_base (325)..(325): a, c, t, g, unknown or other
  modified_base (535)..(535): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccaggggaagggctggagtgggtgccaanataaagcaagatggaagtgaagaaatactatgtggactctgtgaagggccgattcaccatctccagagacaaacgccaaagaactttacngtatctgacaaatgaacagcctgagaggcgaggacaccggctctgtattacgtgtgcggaggactaccctcctcgtcggggccgggtccgtacggtttcctacggcagtgggaccgtcgtcggggaccgaacgggaccgaccggtcgaccgtctcccgtcacgcctcccaccgaacgggcccacgtccggtcccttcccccgtcggcccncccctccctacccaacgacgccgaccgtccgttcgggggcacgaacggccggccgtcgggcttcgtccgttcggtaaccg

SEQ ID NO: 373073 - DNA, 677 bp, Homo sapiens
  misc_feature: GZ8MTXP01DY89Y.15.87.H10.1.454.CMB.2.raw
  modified_base (345)..(345): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagcttgggttttccttgttgctattttagaaggtgtccagtgtgaggtgcaggttggtggagtcgtgggggagcttggtccaaccgtgggggtccctgagactctctgtgcagcctctggattcattactttaatgttttgatcgaccgtgggtccgcgagggtccgaggggagggctggaggtgggcgaccaaanaagtaaagcgaaagagtaggaaagtgaaacgaaatactagtgtggaaacttcgtgggtaggaaacggggccctaattccaacctactacctaccgaagaacggaaccaaccggtaccaaaagtaaacctttatagtaactctagaactaaaatcgaaacacgtaccgtaggaaggacggaccggaaggaaccgttaacggtcttacgttaggtttaacttggtaagtggacggttaacggacttaaccccgtcgttcggttcgggggacccggtcccgttaacgggttttccccgaacggtcgttacggtttcggggaacccggttccgggg

SEQ ID NO: 373074 - DNA, 596 bp, Homo sapiens
  misc_feature: GZ8MTXP01EYBP6.15.87.H10.1.454.CMB.2.raw
  modified_base (233)..(233): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcattctttaatagtttttggatgacctgggtccgcagggtccagggagggctggagtgggtgccaanataaagcaagatggaagtgaagaaatactatgtggactctgtgaagggccattcaccatctccagagacaaacgccaaagaacttactgtatctgacaaaatgaacagcctgagagcgaggacaccggctctgtattactgtgcgagactaccctcctcgtcgggccgggtaccgtacggtttcctacggcagtacgggacgtcgtcggggaccgaacgggaccgacggtccaccgtctcctcacgcctaccgaccgaacgggcccagttccggtccttccccgtcggcccaccctcctccaacgacgcgaccgtcgttcgggggcacgaagccggccgtcgggcttcgtccgttggtaaccg

SEQ ID NO: 373075 - DNA, 622 bp, Homo sapiens
  misc_feature: GZ8MTXP01BAB64.15.87.H10.1.454.CMB.2.raw
  modified_base (234)..(234): a, c, t, g, unknown or other
  modified_base (376)..(376): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattctttaatagtttttggatgacctgggtccgccagggtccagggagggctggagtggtgccaanataaagcaaagatggaaagtgaagaaatactatgtggactctgtgaagggccattcaccatctcagagacaacgccaaagaacttactgtatctgacaaaatgaacagcctagagaggcgaggacaccggctgtgtattacnggtgcgagactaccctcgtcgtcggggcgggtcctacggtttccgtacggcgagtgggacgtcggtcggggaccgaacgggaccacggtcaccgtcctcctcgacgccctccgaaccgaacgggcccctacgtccggtcccttcccccgtcggccctacccctcctcccaaacgcgcctacccgtcgttcgggggccacggaacgcccgggtcccgcggggccttcggtcccgttcgggtaacccg

SEQ ID NO: 373076 - DNA, 662 bp, Homo sapiens
  misc_feature: GZ8MTXP01DKE8K.15.87.H10.1.454.CMB.2.raw
  modified_base (375)..(375): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaagggctggagtgggtggccaacataaagcaagatggaagtgagaaatactatgtggactctgtgaagggccattcaccatctccagaagacaaacgccaaagaacttactgtatctgacaaaatgaacagcctgagaggcgaggacacggctctgtattacngtgcgaggactaccctcctcgtgggcggggcctacggtttccacgggcagtgggacgtcgtcgggggaccgaaacggggaccgacgggtccacccggttcctacccgttccacggccccttaccccgaacccgaaaccggggcccctaacgttcccggggttcccctttccccccgttcgggcccctaacccccgtcccctacccgaaacgacgcccgtaacccgtcggttcgggggccaccgaacggcccggcccgtcggggccttcggtcccgttgggtaacccg

SEQ ID NO: 373077 - DNA, 577 bp, Homo sapiens
  misc_feature: GZ8MTXP01D7HC7.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgaagaaatactatgtggactctgtgaagggccgattcaccatctccagagacaacgccaaagaacttactgtatctgacaaatgaaacagcctgagaggcgaggacacggctctgtattactgtgcgaggactaccctcctgtcgggcgggcccaggtttcctacggcagtggacgtcgtggggccgaagggaccgacggtcaccgtcctccgtcacgcctaccaccgaacgggcccacgtccggtccttcccctcggccaccctcctccagacgcacctcgttcggggcacgaagcggcccgtgggcttcgccgttggtaaccg

SEQ ID NO: 373078 - DNA, 586 bp, Homo sapiens
  misc_feature: GZ8MTXP01C99CC.15.87.H10.1.454.CMB.2.raw
  modified_base (519)..(519): a, c, t, g, unknown or other
  modified_base (532)..(532): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaagggctggagtgggtggccaacataaagcaaagatggaaagtgaagaaatactatgtggactctgtgaagggccgattcacatctcagagacaacgccaaagaacttactgtatctgacaaatgaacagcctgagagcgaggacaccggctctgtattactgtgcgagacttaccctcctcgtgggccgggccgtacggtttccgtacggcagtcggacgtcgtcggggaccgaacgggaccgacgtcaccgtcctccgtcacgcctaccaccgaacggcccacgtccgtccttccccgtcgcccnccctcctccagcnccgaccgtcgttcggggcacgcgccggcccgtcgggcttcgtccgttggtaacg

SEQ ID NO: 373079 - DNA, 582 bp, Homo sapiens
  misc_feature: GZ8MTXP01A25VG.15.87.H10.1.454.CMB.2.raw
  modified_base (520)..(520): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatctttaatagtttttggatgacctgggtccgccagggtccagggaagggctggagtgggtggccaacataaagcaagatggaaagtgaagaaatactatgtggactctgtgaagggccattcaccatctccagagacaacgccaaagaacttactgtatctgcaaatgaacagcctgagaggcgaggacacggctctgtattactgtgcgaggataccctctcgtgggcgggcctaggtttcctacggcagtggacgtcgtggggccgaagggaccacggtcaccgtcctccgtcacgcctacccaccgaacgggcccacgtccggtccttcccccgtggcccacccctccnccaaacgcgccaccctcgcgggggcacgaacgccggcccgtgggcttcgccgttggtaaccg

SEQ ID NO: 373080 - DNA, 604 bp, Homo sapiens
  misc_feature: GZ8MTXP01DYCAF.15.87.H10.1.454.CMB.2.raw
  modified_base (243)..(243): a, c, t, g, unknown or other
  modified_base (304)..(304): a, c, t, g, unknown or other
  modified_base (309)..(309): a, c, t, g, unknown or other
  modified_base (374)..(374): a, c, t, g, unknown or other
  modified_base (383)..(383): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattcttttaatagtttttggatgacctgggtccgccaggggtccaggggaaggggctggagtggggtggccaaanataaaagcaaagatggaaagtgaagaaatactatgtggactctgtgaaggccatcacatcncaganacaacgccaaagaacttactgtatctgacaaaatgaaacagcctagagaggcgaggacacggctntgtattacngtgcgagactaccctctcgtgggcgggtcctaggtttcctacggcagtggacgtcggtcgggaccgaacgggaccgacggtcaccgtcctccgtcacgccctaccaaccgacggcccacgtcccgtcccttcccctcggccctcccctccctaccgaacgacgccgaccgtcggcgggggccacgaacggccggccgtcggcgttcgccgttcggtaaccg

SEQ ID NO: 373081 - DNA, 674 bp, Homo sapiens
  misc_feature: GZ8MTXP01BV6ZU.15.87.H10.1.454.CMB.2.raw
  modified_base (198)..(198): a, c, t, g, unknown or other
  modified_base (233)..(233): a, c, t, g, unknown or other
  modified_base (289)..(289): a, c, t, g, unknown or other
  modified_base (292)..(292): a, c, t, g, unknown or other
  modified_base (297)..(297): a, c, t, g, unknown or other
  modified_base (313)..(313): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccncagggtccagggaaggggctggagtgggtgccaanataaagcaagatggaagtgaagaaatactatgtggactctgtgaagggccatcacntcncaganacacgcaagacttacngtatctgacaaatgaacagcctaggagacggcgaggaccacggctacgtaggttacttacgtggtcgcggaagggtacttacccgtcccgtcgttcggggcccgggtaccgtacgggtttccgtaaccgggcgtaacgtcgggaaccggttccgggtacgggggacccgaaacggggacccgtaccgggtcccgtaccgttcccgtccctccgaaccgtcccctacccgaaccgaaccgggcccctaacgtcccggttccccttccccgtcggccctcccctcccgtacccgaacgacgccgaaccgtccggttcgggggccacgcggcccggcccgtgggcgttcgccgttcggtaaccg

SEQ ID NO: 373082 - DNA, 553 bp, Homo sapiens
  misc_feature: GZ8MTXP01DSX5E.15.87.H10.1.454.CMB.2.raw
  modified_base (412)..(412): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcatctttaatagtttttggatgacctgggtccgccgagggtccagggaggggctgggagtgggtgccaacataaagcaagatggaagtgaagaaatactagtgtggaactcgtgtgaagggccgattcacatctcaganacaacgccaaagaacttactgtatctagactaaatgaaacacgcctagaggaggcgaggacacggtctcgtgtattcgtgtgcgacggataccctcgttcgttcgggccggcctaggttccacggcagtcggaacgtcggg

SEQ ID NO: 373083 - DNA, 634 bp, Homo sapiens
  misc_feature: GZ8MTXP01BBX76.15.87.H10.1.454.CMB.2.raw
  modified_base (242)..(242): a, c, t, g, unknown or other
  modified_base (302)..(302): a, c, t, g, unknown or other
  modified_base (376)..(376): a, c, t, g, unknown or other
tcagtctacgtagccacgaccggtgctcgatttagcagtactgcgttgggttttccttgttgctattttagaaggtgtccagtgtgaggtgcagttggtggagtcgtgggggaggcttggtccaaccgtggggggtccctgagactctcctgtgcagcctctggattcattctttaattagtttttggatgaccgtgggtccgcgagggtccgaggggaagggctggagtgggtgaccaaanataaagcaagataggaagtgaagaaatactatgtgactcgtgtgaaggccatcaccatcnccagacaacaacgaccaaagaacttactgtatctagaacaaatgaaacagcctaggagaggcgagacacggctntgtatacgtgtgcgagtactcccgtccgtgtcggggccggtccgtacggtttcccgacggctacggtcggtacgtcggtacggggaccgaaacgggacccgtaccggtccaccgtcctccgtcacgccctacccgaaccgaacggccctacgtccccgtcccttcccccgtcggccctccccttccaccgaacgacgccgtacccgtcggcggggccaccgaacggccgtcccgtgggcttcgtccgttggtaacccg

SEQ ID NO: 373084 - DNA, 571 bp, Homo sapiens
  misc_feature: GZ8MTXP01AZRML.15.87.H10.1.454.CMB.2.raw
  modified_base (502)..(502): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtgggggtccctgagactctcctgtgcagcctctggattcattctttaatagtttttggattgaccgtgggtccgccgagggtccgagggaggggctgggagtgggtggaccaaacgagtaaagcaaagataggaagtgaagaaatatatgtggaactcgtgtgaagggccagttcacatctaccagacacaacgaccaaagtaacttactgtatctagacaaatgaacagcctaggacgaggcgaggacacggctcgtagtattacgngtcgcggagctacccgtcttcgttcgggccgggtcctagggtttcccacggcagtcgggaaccgtcggg

SEQ ID NO: 373085 - DNA, 597 bp, Homo sapiens
  misc_feature: GZ8MTXP01BJO19.15.87.H10.1.454.CMB.2.raw
  modified_base (201)..(201): a, c, t, g, unknown or other
  modified_base (234)..(234): a, c, t, g, unknown or other
  modified_base (275)..(275): a, c, t, g, unknown or other
  modified_base (294)..(294): a, c, t, g, unknown or other
  modified_base (340)..(340): a, c, t, g, unknown or other
  modified_base (526)..(526): a, c, t, g, unknown or other
  modified_base (540)..(540): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattctttaatagtttttggatgacctgggtccncagggtccagggagggctggagtgggtgccaanataaagcaaagatggaaagtgaagaaatactatgtggactntgtgaagggcatcacatcncagagacaaacgccaaagaacttactgtatctgacaaaatgaaacngcctgagaggcgagacacggctactgtattcgtgtgcgaggactacccgtcctcgtgggccgggtcctacggtttccgtacggcagtcggacggtcgtcggggaccgaagggaccgacgggtccaccggtcctccgtacacgccctaccaccgaacggcccagtccggtcccttccccgtcgcccnccctcctccaagcncgaccgtcgttcgggggcacgcggccggccctcggggcttcggtccgttggtaaccg

SEQ ID NO: 373086 - DNA, 622 bp, Homo sapiens
  misc_feature: GZ8MTXP01CAZTE.15.87.H10.1.454.CMB.2.raw
  modified_base (295)..(295): a, c, t, g, unknown or other
  modified_base (320)..(320): a, c, t, g, unknown or other
  modified_base (362)..(362): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattctttaatagtttttggatgacctgggtccgccagggtccagggaagggctggagtgggtggccaacataaagcaaagatggaagtgaagaaatactatgtgactctgtgaaggccatcacatcncagagacaacgccaaagaacttacngtatctgacaaatgaacagcctgagaggcgagacaccggctntgtatactgtgcgagtactaccctcctcgtcgggccgggcctacggtttcctacggcagtcggacgtcgtcggggaccgaacgggaccgacggtccaccgtcctccgtcacgccctaccaaccgaacggcccacgtccggtcccttcccccgtcggtcccacccctcccgtacccaaacgacgaccgtacccgtccggttcgggggccaaccggcgggcccggtcccggtcggggccgttcggtcccgttcggtaacccg

SEQ ID NO: 373087 - DNA, 601 bp, Homo sapiens
  misc_feature: GZ8MTXP01C0IDR.15.87.H10.1.454.CMB.2.raw
  modified_base (378)..(378): a, c, t, g, unknown or other
  modified_base (523)..(523): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccagggtccagggaagggctggagtgggtggccaacataaagcaaagatggaagtgaagaaatactatgtggactctgtgagggccattcaccatctccagagacaaacgccaaagaactttactgtatctgacaaatgaaacagcctggagaggcgaggacaccggctctgtattacngtgcgagtactaccctctcgtgggccgggtccgtacggtttccgtacggcagtggacgtcgtcggggaccgaacgggaccacggtccaccgtcctccgtcacgccctccaccgacggcccacgtccggtccttccccgtcgcccncccctccgtcccaacgacgccgtaacccgtcggttcgggggccacgaacggccggccgtgggcttcgccgttgtaacg

SEQ ID NO: 373088 - DNA, 591 bp, Homo sapiens
  misc_feature: GZ8MTXP01ENDYN.15.87.H10.1.454.CMB.2.raw
  modified_base (298)..(298): a, c, t, g, unknown or other
  modified_base (378)..(378): a, c, t, g, unknown or other
  modified_base (574)..(574): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaattagtttttggatgacctgggtccgccagggtccagggaagggctggagtgggtgaccaacataaagcaaagatgggaatgaagaaatactatgtggactctgtgaaggccatcacatcncagagacaacgccaaagaactttactgtatctgacaaaatgaaacagcctgagaggcgaggacaccggctctgtattacngtgcgagacttacctccgtcgtgggcgggtcctacggtttccgtaacggcagtggacgtcgtcgggccgaagggaccacggtcaccgtctccgtcacgcctccaccgaacggcccactccggtcccttcccctcggtcccaccctcctaccaacgacgccaccgtcgttcgggggccacgcgccggcccgtgggcncggtccgttggtaaccg

SEQ ID NO: 373089 - DNA, 635 bp, Homo sapiens
  misc_feature: GZ8MTXP01D246Q.15.87.H10.1.454.CMB.2.raw
  modified_base (240)..(240): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattctttaatagtttttggatgacctgggtccgccagggtccaggggaaggggctggagtggggtgccaaanataaagcaaagatggaagtgaagaaatactatgtggactctgtgaagggccattcacatctcagaagacaaacgccaaagactttactgtatctgacaaaatgaaacagcctagagaggcgaggtacacggctcgtagtacttactggtgcgaggactacccgtcctcgtggggccgggtccgtacggtttccgtacggcgagtcggacggtcggtacggggaccgaacgggaccgacggtcacccgtccttccgtcacgccctacccgacccgaacgggcccctacgtccggttcccttcccccgtcggccctacccctccctacccaacggcgccgtaccgtcggttcgggggccacgcgccggccgtcgggcgttcgtccgttcggtaaccg

SEQ ID NO: 373090 - DNA, 604 bp, Homo sapiens
  misc_feature: GZ8MTXP01AM8VK.15.87.H10.1.454.CMB.2.raw
  modified_base (324)..(324): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgccagggtccaggggaaggggctggagtgggtggccaacataaagcaagatggaagtgaagaaatactatgtggactctgtgaagggccattcaccatctcagagacaacgccaaagaacttacngtatctgacaaaatgaacagcctgagaggcgaggacacggctctgtactactgtgcgaggactaccctcctcgtggggcgggtcctacggtttcctacggcagtgggacgtcgtcggggaccgaagggaccacggtcaccgtctcctcacgcctaccaccgaacgggcccacgtccggtcccttcccccgtcggcccacccctccctaccgaacgaccgccgaccgtcgttcgggggcaccgaacggccggcccgtgggccttcgtccgttgggtaaccg

SEQ ID NO: 373091 - DNA, 596 bp, Homo sapiens
  misc_feature: GZ8MTXP01BF8D0.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccattcaccatctccagagacaaacgccaaagaacttactgtatctgcaaaatgaacagcctgagaggcgaggacaccggctctgtattacgtgtgcgaggactaccctcctcgtggggcgggacctacggtttcctacggcagtggacgtcgtcggggccgaagggaccacggtcaccgtctcctcacgccctaccaccgaacgggcccacgtccggtccttcccccgtcggcccacccctccctcccaagacgcgacccgtcgttcgggggcacgaacgccggcccgtcgggcttcggtccgttggtaaccg

SEQ ID NO: 373092 - DNA, 588 bp, Homo sapiens
  misc_feature: GZ8MTXP01AJ9AH.15.87.H10.1.454.CMB.2.raw
  modified_base (239)..(239): a, c, t, g, unknown or other
  modified_base (301)..(301): a, c, t, g, unknown or other
  modified_base (329)..(329): a, c, t, g, unknown or other
  modified_base (380)..(380): a, c, t, g, unknown or other
tcagtctacgtagccacgaccggtgctcgatttagcagtactgcgttgggttttccttgttgctattttagaaggtgtccagtgtgaggtgcagttgttggagtctggggggaggcttggtccaaccgtggggggtccctgagactctcctgtgcagcctctggattcatcttttaatagtttttggatgacctgggtccgccagggtccaggggaaggggctggagtgggtggccaanataaagcaaagatggaagtgaagaaatactatgtggactctgtgaagggccattcaccatcnccagagacaaacgccaaagaactttacngtaatctgcaaaatgaacagcctgagaggcgaggacacggctctgtatacngtgcgaggactaccctcctgtggggccggtccgtacggtttccgtacggcacgtggacgtcgtggggccgaacgggaccacggtcaccgtctcctcacgcctccgaccgaacggcccacgtccggtcccttccccgtcggccaccctcctccagacgcacctcgttcggggccacgaacgcgcccgtgggcttcgccgttcggtaacg

SEQ ID NO: 373093 - DNA, 585 bp, Homo sapiens
  misc_feature: GZ8MTXP01DXIR8.15.87.H10.1.454.CMB.2.raw
  modified_base (380)..(380): a, c, t, g, unknown or other
  modified_base (400)..(400): a, c, t, g, unknown or other
  modified_base (515)..(515): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccaggggaaggggctggagtggggtggccaacataaagcaagatggaagtgaagaaatactatgtggactctgtgaagggccgattcaccatctccagagacaaacgccaaagaactttactgtatctgacaaaatgaaacagcctgagaggcgaggacacggctctgtattacngtgcgagactaccctcctgngggcgggcctaggtttccgtacggcagtggacgtcgtcggggccgaagggaccgacggtcaccgtcctcctcacgcctccaccacggcccacgtccggtccttcccctcggcccncccctcctccaagacgcaccgtcgttcgggggcacgcggccggccgtgggcttcgccgttcgggtaaccg

SEQ ID NO: 373094 - DNA, 665 bp, Homo sapiens
  misc_feature: GZ8MTXP01BFNWT.15.87.H10.1.454.CMB.2.raw
  modified_base (329)..(329): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcattctttaatagtttttggatgacctgggtccgccgagggtccaggggaaggggctggagtgggtgccaacataaagcaagatggaagtgaagaaatactagtgtggactctgtagaacgggccgattcacatctccagagacaacgaccaaagaacttacngtactctgaactaaatcgaaacagcctaggagaggcgaagggaccaccgggcttcgtagttacttacgtggtagccggaaggtactaccctccgtcgtcggggccggtaccgtacggtttccgacggcgacgtcggacgtcgggtcggggaccgaacgggaccaccggtcaccgtcctccgtacgacgccctaccgaccgaacgggcccctacgttccccggtcccttcccccgtccgaccctccccgtcctaccgaaacgtccgccgtacccgtcggttccgggggccaccggaaccggtccggcccgtcgggcttcggtcccgttggtaacccg

SEQ ID NO: 373095 - DNA, 665 bp, Homo sapiens
  misc_feature: GZ8MTXP01ARA7V.15.87.H10.1.454.CMB.2.raw
  modified_base (275)..(275): a, c, t, g, unknown or other
  modified_base (295)..(295): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaagggctggagtgggtggccaacataaagcaaagatggaagtgaagaaatactatgtggactntgtgaaggccatcaccatcncagagacaacgccaaagaactttactgtatctgacaaatgaacagcctgagaggcgaggacaccggctcgtgtattactgtcgcgaggactaccctcctcgtcggggccgggtcccgtacggtttcccgtaacgggccgagttcgggaccggttcggtcgggggacccggaaacgggggacccgtaccgggtccgacccgttccctcccgtcgacgcccctaccccgaacccgaaacggggcccctacgttcccggttccccttcccccgtccgggccctacccccgtccctacccgaaacgaccgccgtacccgtcgttcgggggccacgcggccggcccgtcgggccgttcggccgttcgggtaaccg

SEQ ID NO: 373096 - DNA, 572 bp, Homo sapiens
  misc_feature: GZ8MTXP01DI3K4.15.87.H10.1.454.CMB.2.raw
  modified_base (369)..(369): a, c, t, g, unknown or other
  modified_base (378)..(378): a, c, t, g, unknown or other
  modified_base (394)..(394): a, c, t, g, unknown or other
  modified_base (507)..(507): a, c, t, g, unknown or other
  modified_base (544)..(544): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccaggggtccaggggaaggggctggagtggggtggccaacataaagcaagatggaagtgaagaaatactatgtggactctgtgaagggccattcaccatctccagagacaacgccaaagaacttactgtatctgcaaaatgaaacagcctggagaggcgaggacacggctntgtattacngtgcgagataccctcncgtgggcgggcctaggtttcctacggcatggacgtcgtgggaccaagggaccacggtcaccgtctcctcacgccctccaccaacggtcccagtccggtccttcccctcggccnccctcctccaacgcgccaccgtcgttcgggggcacgngccgccgtgggcttgcccgttgtaaccg

SEQ ID NO: 373097 - DNA, 623 bp, Homo sapiens
  misc_feature: GZ8MTXP01A2MT0.15.87.H10.1.454.CMB.2.raw
  modified_base (239)..(239): a, c, t, g, unknown or other
  modified_base (295)..(295): a, c, t, g, unknown or other
  modified_base (365)..(365): a, c, t, g, unknown or other
  modified_base (376)..(376): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattctttaatagtttttggatgacctgggtccgccgagggtccaggggaaggggctggagtgggtgccaanataaagcaagatggaagtgaagaaatactatgtgactctgtgaaggcatcacatcncagagacaacgcaaagtacttactgtatcagacaaaatgaaacagcctaggagaggcgaggacacggctntgtacttacgngtgcgaaggacttaccctccgtcgtggggcccggtacccgtacggtttacccgtacgggctaacgtcgggtacggtcggtcgggggaccgaaacggggacccgacggtccacccgtcctccgtcacggcccctaccgaacccgacgggccccacgtcccggtcccttcccccgcgtcccacccctcctaccacgacgccgaccgtcgcggggcacgcgccggcccgtggcttcgccgttggtaaccg

SEQ ID NO: 373098 - DNA, 633 bp, Homo sapiens
  misc_feature: GZ8MTXP01ENQ8X.15.87.H10.1.454.CMB.2.raw
  modified_base (298)..(298): a, c, t, g, unknown or other
  modified_base (326)..(326): a, c, t, g, unknown or other
  modified_base (346)..(346): a, c, t, g, unknown or other
  modified_base (370)..(370): a, c, t, g, unknown or other
  modified_base (379)..(379): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaaggggctggagtgggtggccaaacataaagcaagatggaagtgaagaaatactatgtggactctgtgaagggccattcaccatcnccagagacaaacgccaaagaactttacngtatctgacaaaatgaaacngcctgagaggcgaggacacggctntgtattacngtgcgaggactaccctctcgtggggcgggtcctacggtttcctacggcagtggacgtcgtggggaccgaacgggaccacggtcaccgtctccgtcacgccctaccaccgaacggcccacgtccggtcccttcccccgtcggcccaccccgttccctacccgaaacggtaccgaccgtaacccgtcgggttcgggggcccaaccggaacggcccgggtcccgtcgggggccgttcggtcccgttcgggtaacccg

SEQ ID NO: 373099 - DNA, 652 bp, Homo sapiens
  misc_feature: GZ8MTXP01BLWW3.15.87.H10.1.454.CMB.2.raw
  modified_base (198)..(198): a, c, t, g, unknown or other
  modified_base (278)..(278): a, c, t, g, unknown or other
  modified_base (295)..(295): a, c, t, g, unknown or other
  modified_base (300)..(300): a, c, t, g, unknown or other
  modified_base (321)..(321): a, c, t, g, unknown or other
  modified_base (341)..(341): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccnccagggtccaggggaaggggctggagtgggtgccaacataaagcaagatggaaagtgaagaaatactatgtggactctgngaagggcattcacatcncaganacaacgccaaagaactttacngtatctgacaaaatgaaacngcctgagaggcgaggacacggctctgtattacgtgtgcgaggtactacccgtcctcgtggggcgggtcctacggtttccgtacggcagtcggacggtcgtacgggggaccgaaacggggaccgaccggtccgacccgttccgtccctcgacgccctacccgaacccgaaacgggcccctacgttcccggttcccttcccccgtcggccctaaccccgtccctacccgaaacggacgacccgtacccgtcggttcgggggccacggaacggcccgggcccgttcggggccttcggtcccgttgggtaacccg

SEQ ID NO: 373100 - DNA, 638 bp, Homo sapiens
  misc_feature: GZ8MTXP01CFILI.15.87.H10.1.454.CMB.2.raw
  modified_base (261)..(261): a, c, t, g, unknown or other
  modified_base (308)..(308): a, c, t, g, unknown or other
  modified_base (470)..(470): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagcttgggttttccttgttgctattttagaaggtgtccagtgtgaggtgcaggttggtggagtcgtgggggagcttggtccaacgtgggggtccctgagactctcctgtgcngcctctggtattcattctttaatagtttttggatgaccgtgggtccnccgagggtccaggggaaggggctgggaggtgggtggaccaagaataaagcaaagatagggaagtgaaacgaaatactagtggtggaaacttcgtgtaggaacggggccgtattccaacatccgtaccagaacgacaaccgaccaaagtaacttactagtacnctgaacaaatagaaacgtagccctagacgagggcgaaggaccacgggctacgtaggttacttacgtgtcggacggacggttacttaccccgtccgttccggttcgggttcccgggtaaccgttacggtttcccgtacgggccttacggtcgggttaacggttccgggg

SEQ ID NO: 373101 - DNA, 608 bp, Homo sapiens
  misc_feature: GZ8MTXP01DBAJ4.15.87.H10.1.454.CMB.2.raw
  modified_base (462)..(462): a, c, t, g, unknown or other
  modified_base (532)..(532): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctatttagaaggtgtccagtgtgaggtgcagttggtggagtcgtgggggaggcttggtccaacgtggggggtccctgagactctcctgtgcagcctctggattcattctttaatagttttggatgacctgggtcccgccgagggtccgaaggggaaggggcgtgggaggtggggtaggaccaaacaagtaaaagcaaagataggaagtgaagaaatatagtgtggaactctggtagaacggggcctattaccactatctaccaagacgaacaacgaccaaaagtaacttacgtntaactctagacaaaatcgaaactagccgtagaggaggccgtaggaccacggtctcgtagtacttagtggngcgaagacttaccctccgttgcggggccgtaacccgtaaggtttccccaagggccttaggtcggaacgttccgggg

SEQ ID NO: 373102 - DNA, 603 bp, Homo sapiens
  misc_feature: GZ8MTXP01CQHRG.15.87.H10.1.454.CMB.2.raw
  modified_base (537)..(537): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttgggtccaacctgggggggtccctgagactctcctgtgcagcctctggattcatctttaatagtttttggatgacctgggtccgccgaggggtccaggggaagggctggaggtggggtggccaaacataaaagcaaagataggaagtgaagaaatactatgtggactcgtgtgaagggccattcaccatctccagagacaacgccaaagaactttactgtatctagacaaatgaacagcctaggagaggcgaggacaccggctctgtatactgtgcgaggactacctctcgtggggccgggctacggtttcctacggcagtgggacgtcgtcggggaccgaacgggccacggtcaccgtcctccgtcgacgccctacccgaccgaacgggccccagtcccggtcccttcccccgcggcccncccctccctcaacgacgccgaccgtcgcggggcacgcgccggccgtggcttacgccgttggtaacg

SEQ ID NO: 373103 - DNA, 613 bp, Homo sapiens
  misc_feature: GZ8MTXP01EXSRA.15.87.H10.1.454.CMB.2.raw
  modified_base (237)..(237): a, c, t, g, unknown or other
  modified_base (278)..(278): a, c, t, g, unknown or other
  modified_base (297)..(297): a, c, t, g, unknown or other
  modified_base (302)..(302): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatcttttaatagtttttggatgacctgggtccgccagggtccaggggaagggctggagtgggtgccaaanataaagcaaagatggaaagtgaagaaatactatgtggactntgtgaaggccatcacatcncaganacaacgccaaagaacttactgtatctgacaaaatgaaacagcctggagaggcgaaggaccacggctctgtattactgtgcgagactaccctctcgtcggggccgggccgtaggtttcccgtacggcgagtcgggacgtcgtcggggaccgaaacgggaccacggtccaccgtcctccgtcacgccctacccaccgaacgggcccacgtccggtcccttccccgtcggcccacccctccctaccaaacgacgccgacccgtcgttcgggggccacgcggccggcccgtgggccttcgtcccgttggtaaccg

SEQ ID NO: 373104 - DNA, 615 bp, Homo sapiens
  misc_feature: GZ8MTXP01B2B2D.15.87.H10.1.454.CMB.2.raw
  modified_base (300)..(300): a, c, t, g, unknown or other
  modified_base (305)..(305): a, c, t, g, unknown or other
  modified_base (533)..(533): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcattctttaattagtttttggatgacctgggtccgccgagggtccaggggaaggggctggagtgggtggccaacataaagcaaagatggaagtgaagaaatactatgtggactctgtgaaggccattcacatcncaganacaacgccaaagaacttactgtatctgacaaaatgaacagcctgagaggcgaggacaccggctctgtattacgtgtgcgaggactaccctcctcgtgggccgggtcctaggtttccacggcagtcgggacgtcgtcgggggaccgaacggggaccacggtccaccgtcctcctcacgccctaccgaaccgaacgggcccacgtcccggtcccttcccccgtcggcccncccctccctcccgaaacgcgccacccgtcggttcgggggccaccgcggcccggcccgtgggcttacggccgttcggtaaccg

SEQ ID NO: 373105 - DNA, 705 bp, Homo sapiens
  misc_feature: GZ8MTXP01BI2PM.15.87.H10.1.454.CMB.2.raw
  modified_base (199)..(199): a, c, t, g, unknown or other
  modified_base (229)..(229): a, c, t, g, unknown or other
  modified_base (270)..(270): a, c, t, g, unknown or other
  modified_base (290)..(290): a, c, t, g, unknown or other
  modified_base (315)..(315): a, c, t, g, unknown or other
  modified_base (350)..(350): a, c, t, g, unknown or other
  modified_base (361)..(361): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcattctttaatagtttttggatgactgggtccncagggtccagggaggctggagtggtgcaanataaagcaagatggaagtgaagaaatactatgtgactctgngaaggcatcacatctcaganacaacgccaaagacttactgtactntgacaaatgaacagctgagaggcgagacacggctntagtattacgngtgcgaggtactacccgtcctcgtcgggcgggtacccgtacggtttcccgtaacggcgtaacgtcggtaacggttcggtcgggggaaccgaaacggggacccgaaccgggttccaaccgttcctcctaccgacggtaccctacccgaaccgaaaccgggcccctaacgttccccgggtcctttcccccccgtggtcccctaccccgtaaccctaaccgttaaacgggaccgttacccgtaacccggttcgggttaccggggggaccaacccgggaaccgggtccccggggaacccggttccgggggcccgttaaccgggtcccggttaacgggttaaacccggg

SEQ ID NO: 373106 - DNA, 628 bp, Homo sapiens
  misc_feature: GZ8MTXP01DLDYY.15.87.H10.1.454.CMB.2.raw
  modified_base (235)..(235): a, c, t, g, unknown or other
  modified_base (320)..(320): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcattctttaatagtttttggatgacctgggtccgccagggtccagggaagggctggagtgggtgccaanataaagcaaagatggaaagtgaagaaatactatgtggactctgtgaagggcatcacatctcagagacaacgccaaagaacttacngtatctgacaaatgaacagctagagagcgaggacacggctctgtattactgtgcgaggactaccctcgtcgtggggcgggccgtacggtttccgtacggctagtcgggacggtacggtcgggggaccgaaacggggacccgacgggtccaacccgtcctccgtaccgacgccctacccgaacccgaacgggcccctacgttcccgggttcccttcccccgtcggccctacccctccctaccaacgacgccgtaccgtcggttcggggcaccgaacgccggcccgtgggccttcgtccgttggtaaccg

SEQ ID NO: 373107 - DNA, 632 bp, Homo sapiens
  misc_feature: GZ8MTXP01ADX9P.15.87.H10.1.454.CMB.2.raw
  modified_base (235)..(235): a, c, t, g, unknown or other
  modified_base (243)..(243): a, c, t, g, unknown or other
  modified_base (307)..(307): a, c, t, g, unknown or other
  modified_base (332)..(332): a, c, t, g, unknown or other
  modified_base (352)..(352): a, c, t, g, unknown or other
  modified_base (380)..(380): a, c, t, g, unknown or other
  modified_base (410)..(410): a, c, t, g, unknown or other
tcagtctacgtagccacgaccggtgctcgatttagcagtactgcgttgggttttccttgttgctattttagaaggtgtccagtgtgaggtgcagttggtggagtcgtggggggaggcttggtccaaccgtggggggtccctgagactctcctgtgcagcctctggattcattctttaattagtttttggatgacctgggtccgccgagggtccgaggggaagggctggagtgggngaccaaanataaagcaagataggaagtgaagaaatactagtgtggactctgtagaagggccattcaccatcncagagacaacgccaaagaactttcngtatctagacaaaatgaacngcctaggagaggcgaaggaccacggctntagtaattcgtgtgcgagactacctcctgngggcggtcctacggtttccacggcaacgtcggacgtcggtacggggaccgaacgggacccgacggttccaccggtccttccccgcgaccgcccacccgaccggaccggccctaccgttcccgtccccttccccgcgcccctcccctcctacgacgccgccgtaccgtcgggcgggcaccgcgggcccggtccggcggccgttcggtaaccgttcggtaaccg

SEQ ID NO: 373108 - DNA, 596 bp, Homo sapiens
  misc_feature: GZ8MTXP01BTT70.15.87.H10.1.454.CMB.2.raw
  modified_base (234)..(234): a, c, t, g, unknown or other
  modified_base (526)..(526): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaanataaagcaagatggaagtgaagaaatactatgtggactctgtgaagggccattcaccatctccagagacaaacgccaaagaacttactgtatctgacaaaatgaaacagcctgagaggcgaggacacggctctgtattactgtgcgaggactaccctcctcgtgggccgggtcctacggtttccgtacggcgtagtcgggacgtcgtcggggccgaacggggaccgacggtcaccgtctccgtcacgccctaccaccgaacgggcccagtccggtccttccccgtcggcccnccctccctccaacgcgccgaccgtcgttcgggggcacgcggcggcccgtgggcttcgccgttggtaaccg

SEQ ID NO: 373109 - DNA, 653 bp, Homo sapiens
  misc_feature: GZ8MTXP01CN0PH.15.87.H10.1.454.CMB.2.raw
  modified_base (198)..(198): a, c, t, g, unknown or other
  modified_base (232)..(232): a, c, t, g, unknown or other
  modified_base (363)..(363): a, c, t, g, unknown or other
  modified_base (634)..(634): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccnccagggtccagggaaggctggagtggtggccaanataaagcaaagatggaaagtgaagaaatactatgtggactctgtgaagggccattcacatctccagagacaaacgccaaagaacttactgtatctgacaaatgaaacagcctgagaggcgaggacaccggntctgtattacgtgtgcggagtactaccctccgtcgtcggggcgggtacccgtagggtttcccgtaacggctagtcgggtacggttcggtacgggggaccgaaacggggaccacgggtccaccgtcctccgtaccgacgtccctacccgaaccgaaaccgggcccctaagtcccggttcccttcccccgtcgggaccctacccctccctacgaaacggaccgccgaacccgtcggttcgggggccaacgcgggcccggcccggtggggtccncgtcccgttcgggtaaccg

SEQ ID NO: 373110 - DNA, 608 bp, Homo sapiens
  misc_feature: GZ8MTXP01BBD3C.15.87.H10.1.454.CMB.2.raw
  modified_base (228)..(228): a, c, t, g, unknown or other
  modified_base (234)..(234): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattctttaatagtttttggatgacctgggtccgcagggtccagggagggctggagtgggngccaanataaagcaagatggaaagtgaagaaatactatgtggactctgtgaagggccattcacatctcagagacaacgccaaagaacttactgtatctgacaaatgaacagcctaggagaggcgaggacacggctacgtgtattcgtgtgcgagtactacctctcgtggggccggtaccgtacggttccgtacggcagtcggacgtcggtcggggaccgtaacgggaccgacggtccaccgtcctccgtcacgccctaccaaccgtacggcccacgtcccggtccttccccgtcggccctacccgtccctaccgaacgacgccgaccgtcgcgggggccacgaacggccggccgtcgggcgttcgtccgttcggtaaccg

SEQ ID NO: 373111 - DNA, 725 bp, Homo sapiens
  misc_feature: GZ8MTXP01DEXPV.15.87.H10.1.454.CMB.2.raw
tcagtctacgtagccacgaccggtgctcgatttagcagtactgcgttgggttttccttgttgctattttagaaggtgtccagtgtgaggtgcagttggtggagtcgtggggggaggcttggtccaaccgtgggggggtccctgagactctcctgtgcagcctctggattcattcttttaattagtttttggatgacctgggtccgccgaggggtccaggggaaggggctggaggtggggtggaccaaacaataaaagcaaagataggaagtgaagaaatactatgtggactcgtgagaagggcctatcaccatctacaagagaacaaacgaccaaagtaactttactagtaactcgtagaactaaaagtcgaaaaccagccgtaggaaggaggcggaaggaccaccggcttgtaggttaacttacgtgtacggcggtaagtacttacccgtccgtcggtcgggggcccgggtacccgtacgggtttacccgtacggcgtacgtcgggacggtacggtacggggaccgaacggggacccgacggtaccacccgtcctcccgtcgaaccgtcccctacccgaacccgaaccggccccacgttccccggttcccttcccccgtaccggcccctacccctccctaccgaacgaccgcccgtacccgtcggttccggggccacggaaccggcccggcccggtcgggccttcggtcccgttcgggtaaccg

SEQ ID NO: 373112 - DNA, 620 bp, Homo sapiens
  misc_feature: GZ8MTXP01B4K00.15.87.H10.1.454.CMB.2.raw
  modified_base (238)..(238): a, c, t, g, unknown or other
  modified_base (298)..(298): a, c, t, g, unknown or other
tcagtctacgtagccacgaccggtgctcgatttagcagtactgcgttgggttttccttgttgctattttagaaggtgtccagtgtgaggtgcagttggtggagtcgtggggggaggcttggtccaaccgtggggggtccctgagactctcctgtgcagcctctggattcattcttttaattagtttttggatgacctgggtccgcagggtccagggaagggctggagtgggtgccaanataaagcaagatggaagtgaagaaatactatgtggactctgtgaaggccgattcacatcncagagacaacgccaaagaacttactgtatctgacaaatgaaacagcctgagaggcgaggacacggctctgtatactgtgcgagactaccctcctcgtcgggcgggtccctacggtttccctacggcagtcggacgtcgtcggggaccgaacgggaccacggtccaccgtcctccgtcacgccctaccaacccgaacgggccccaacgttcccggtcccttcccccgtcggcccacccctccctacccaacggacgccgaacccgtcgttcgggggccaccgaacggcccggcccgtcgggccgttcgtccgttcggtaaccg

SEQ ID NO: 373113 - DNA, 625 bp, Homo sapiens
  misc_feature: GZ8MTXP01EF1PZ.15.87.H10.1.454.CMB.2.raw
  modified_base (228)..(228): a, c, t, g, unknown or other
  modified_base (235)..(235): a, c, t, g, unknown or other
  modified_base (277)..(277): a, c, t, g, unknown or other
  modified_base (374)..(374): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcattctttaatagtttttggatgacctgggtccgcagggtccagggaagggctggagtgggngaccaanataaagcaagatggaagtgaagaaatactatgtggactctgngaagggccattcacatctcagagacaacgcaaagacttactgtatctagacaaaatgaaacagcctagagaggcgaggacacggctatgtattacgngtcgcggaagacttaccctccgtcgtcggggccgggtcctacggtttccgtacggcgtagtcggacgttcggtcgggggaccgaacgggaccgacggtcctaccgttcctccgtcacgtccctaccgaaccgaacgggcccctagttcccggtcccttcccccgtcggccctacccctccctaccgaaagaccgcgacccgtcggttcgggggccacgcggccgcccgtgggccttcgccgttggtaaccg

SEQ ID NO: 373114 - DNA, 641 bp, Homo sapiens
  misc_feature: GZ8MTXP01D4CYG.15.87.H10.1.454.CMB.2.raw
  modified_base (294)..(294): a, c, t, g, unknown or other
  modified_base (297)..(297): a, c, t, g, unknown or other
  modified_base (302)..(302): a, c, t, g, unknown or other
  modified_base (365)..(365): a, c, t, g, unknown or other
  modified_base (376)..(376): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattctttaattagtttttggatgacctgggtccgccagggtccagggaaggggctggagtgggtgccaaacataaagcaaagatggaagtgaagaaatactatgtggactctgtgaaggcatcacntcncaganacaacgaccaaagaacttactgtatctagacaaatgaacagcctgagaggcgagacacggctntgtattctagngcgagacttaccctcctcgtcggggcgggtccgtacggtttccgtacggcgtagtcgggtacgtcggtcgggggaccgaaacggggaccgaccgggtccaaccgtccctaccgtcgaccgtccctacccgaaccgaaccgggccccacgttcccggttcccgttccccctcggcccaccccgtccctaccgaacgacgccgtacccgtcggttacgggggccaccgcgcccgggcccgtcgggcgttcggtccgttcggtaaccg

SEQ ID NO: 373115 - DNA, 756 bp, Homo sapiens
  misc_feature: GZ8MTXP01CLANS.15.87.H10.1.454.CMB.2.raw
  modified_base (304)..(304): a, c, t, g, unknown or other
  modified_base (309)..(309): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgacctgggtccgccaggggtccaggggaagggctggagtggggtggccaaacataaaagcaaagatggaaagtgaagaaatactatgtggactctgtagaaggccatcacatcncaganacaacgccaaagaacttatgtatctgacaaatgaaacagcctaggaggaggacgaggtacgaccggtctcgtagtacttacgtggtacgcggtaggtaccttacccgtccgtcgcggggtccgggtacccgtacgggtttcccgtacggacgtacgtacgggtacgtcgggtacgggggaccgaaacggggacccgtaaccgggtccctacccggttccctcccttacgaccgtccccgtaccccgaaacccggaacccgggacccctacgtttccccgggttccccttttccccccggccgggtaccccctaccccctccccgtaaccgaaacggtcccgacccgtaaccccgtccggggttccggggggcccaacccgggccgggccccgggtcccgggttccggggccgttaccgggtcccggttaacggggttaaaccccggg

SEQ ID NO: 373116 - DNA, 661 bp, Homo sapiens
  misc_feature: GZ8MTXP01DWD56.15.87.H10.1.454.CMB.2.raw
  modified_base (243)..(243): a, c, t, g, unknown or other
  modified_base (287)..(287): a, c, t, g, unknown or other
  modified_base (307)..(307): a, c, t, g, unknown or other
  modified_base (332)..(332): a, c, t, g, unknown or other
  modified_base (394)..(394): a, c, t, g, unknown or other
tcagtctacgtagccacgaccggtgctcgatttagcagtactgcgttgggttttccttgttgctattttagaaggtgtccagtgtgaggtgcagttggtggagtcgtggggggaggcttggtccaaccgtggggggtccctgagactctcctgtgcagcctctggattcattcttttaattagtttttggatgacctgggtccgccgaggggtccaggggaagggctggagtggtgaccaaanataaaagcaaagataggaaagtgaagaaatactatggtggactntgtgaaggccatcaccatcncagagacaacgccaaagaacttacngtaatctagacaaaatgaaacagcctaggagacggcgaaggaccacggctgtgtaattacgnggtgcgagtaactccctccgtcgtcggggccgggtaccctacggtttcccgtaacggcgtagtcgggacggttacggacgggggaccgaaacggggacccacgggtccaccgttcctccgtcgacggccctacccgaaccgaaccgggcccaacgttcccggttcccttcccccgtcggccctacccctccctaccgaaacgcgccgacccgtcggcggggccacgcggcccggtccccgtgggccttcggcccgttggtaacccgg

SEQ ID NO: 373117 - DNA, 653 bp, Homo sapiens
  misc_feature: GZ8MTXP01EDZYR.15.87.H10.1.454.CMB.2.raw
  modified_base (243)..(243): a, c, t, g, unknown or other
  modified_base (363)..(363): a, c, t, g, unknown or other
  modified_base (405)..(405): a, c, t, g, unknown or other
  modified_base (594)..(594): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattcttttaattagtttttggatgacctgggtccgccagggtccaggggaaggggctggagtgggtgaccaaanataaagcaaagataggaagtgaagaaattactagtgtggactcgtggtaggaaggggcctattcaccatctaccagagacaaacgccaaagtaacttactgtatctagacaaatgaaacngcctaggagaggacgaggacaccggcttcgtgtattacgtgngcgaaggtacttacccctcgtacggtcggggccgggtaccgtacggtttaccgtacggcgtagtcgggtacgtcggtacggggaccgaacgggaccgacggtaccaccgtcctccgtcacgccctacccgaaccgaaccggccctacgtcccggtcccttccccgtcgccctaccctcctaccaacgcnccgaccgtcggcggggccacgaacggccggccgtcgggcgttcgtccgttcggtaaccg

SEQ ID NO: 373118 - DNA, 629 bp, Homo sapiens
  misc_feature: GZ8MTXP01CY6JK.15.87.H10.1.454.CMB.2.raw
  modified_base (301)..(301): a, c, t, g, unknown or other
  modified_base (328)..(328): a, c, t, g, unknown or other
  modified_base (404)..(404): a, c, t, g, unknown or other
  modified_base (540)..(540): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcattctttaatagtttttggatgacctgggtccgccgagggtccaggggaaggggctggagtgggtgaccaaacataaagcaaagatggaagtagaagaaatactatgtggactcgtgtgaagggccattcacanctccagagacaacgccaagaacttacngtatctgacaaatgaacagcctgagaggcgaggacaccggctctgtacttactgtgcgagactacccttccgtcgngggccgggccgtacggtttccgtacggcgagtgggacgtcggtcggggaccgaacgggaccgaccggtaccgaccgtcctccgtcgacgccctacccaaccgaccggcccacgtccgtcccttccccgtcggcccncccctccctcccgaacgtacgccgtacccgtcgttcgggggccaccggaacgcccggcccgtcgggccttcggtccgttcggtaaccgg

SEQ ID NO: 373119 - DNA, 670 bp, Homo sapiens
  misc_feature: GZ8MTXP01CNRE1.15.87.H10.1.454.CMB.2.raw
  modified_base (243)..(243): a, c, t, g, unknown or other
  modified_base (303)..(303): a, c, t, g, unknown or other
  modified_base (345)..(345): a, c, t, g, unknown or other
  modified_base (418)..(418): a, c, t, g, unknown or other
tcagtctacgtagccacgaccggtgctcgatttagcagtactgcgttgggttttccttgttgctattttagaaggtgtccagtgtgaggtgcagttggtggagtcgtgggggaggcttggtccaaccgtggggggtccctgagactctcctgtgcagcctctggattcattctttaattagtttttggatgaccgtgggtccgccgagggtccaggggaaggggctggagtgggtgaccaaanataaagcaagatggaagtgaagaaatactatggtgactcgtgagaaggccattcacatcncagagacaacgccaaagtactatgtatctgacaaatgaaacngctggagaggacgaggaccaccgggtcttacgtgttaacttacgtggtcgaacggaggtaactaccccgttcncggtcggggcgggtcccgtagggtttcgacgtacggcgagtcgggtacgtcggtacggggacccgaaacgggacccgtaacgggtcctaaccccggtcgtacccgttacgaccgacccgtacccgaacccgaacgggccctaacgttcccggttccccttccccgtcggccctaacccctccttacccgaaacgcgtaccgccgttcggcgggccgaacgcggccggtccggtcgggctcggcccgtaaggg

SEQ ID NO: 373120 - DNA, 602 bp, Homo sapiens
  misc_feature: GZ8MTXP01A8SGR.15.87.H10.1.454.CMB.2.raw
  modified_base (241)..(241): a, c, t, g, unknown or other
  modified_base (351)..(351): a, c, t, g, unknown or other
  modified_base (374)..(374): a, c, t, g, unknown or other
  modified_base (383)..(383): a, c, t, g, unknown or other
tcagtctacgtagccacgaccggtgctcgatttagcagtactgcgttgggctttccttgttgctattttagaaggtgtccagtgtgaggtgcagttggtggagtctggggggaggcttgggtccaaccgtgggggggtccctgagactctcctgtgcagcctctggattcattctttaatagtttttggatgacctgggtccgcgagggtccaggggaagggctgggagtgggtggccaanataaagcaagatggaagtgaagaaatactatggtggacttctgtggaagggccgattcaccatctaccagagacaacgccaaagaacttactgtatctgacaaatgaacngcctgagaggcgagaccaggctntgtataacngtgcgagtataccctctcgtcgggccggccgtaggtttccacggctagtgggacgtcgtcggggaccgaacgggacccgacggtccaccgtcgtccctcacgccctaccaaccgacggcccacgtcccggtccctcccctcggcccaacccctcccacacgcgccaccgttcggcggggccaacggacggcccggcccgcgggcctcggcccgtaacgg

SEQ ID NO: 373121 - DNA, 599 bp, Homo sapiens
  misc_feature: GZ8MTXP01CZSZX.15.87.H10.1.454.CMB.2.raw
  modified_base (239)..(239): a, c, t, g, unknown or other
  modified_base (388)..(388): a, c, t, g, unknown or other
  modified_base (413)..(413): a, c, t, g, unknown or other
  modified_base (537)..(537): a, c, t, g, unknown or other
  modified_base (584)..(584): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattctttaattagtttttggatgacctgggtccgccagggtccaggggaagggctggagtgggtgccaaanataaaagcaaagatggaaagtgaagaaaatactaatgtggactctgtgaagggccatcacatctcagagacaaacgccaaagaacttactgtatctgacaaaatgaaacagcctaggagaggcgagggacaccggctgtgtaattacgngtgcgaaggacttaccctccgtcgnggggccggccgtacggtttccgtacggcagtggacgtcgtcggggaccgaaacgggaccgacggtcaccgtcctccgtacacgccctaccaccgaacggcccacgtccgtcctccccgtcgccnccctcctacaagacgcaccgtcgcggggcacgaacgcgcccgtggcncgtccgttggtaacg

SEQ ID NO: 373122 - DNA, 801 bp, Homo sapiens
  misc_feature: GZ8MTXP01AL7RE.15.87.H10.1.454.CMB.2.raw
  modified_base (239)..(239): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgacctgggtccgccagggtccaggggaaggggctggagtgggtgccaanataaagcaagatggaagtgaagaaatactatgtggactctgtgaagggccatcaccatctcagagacaacgccaagaactttactgtatctgacaaaatgaacagccgtaggagacggacggaaggaccaccgggccttcgtaggttaactttacgtgggtacggcggtaacgggtaccttaacccgttcccgtcggttcgggggcccggggtaccccgttacggggttttacccgttaaccggggcgtaacggttcggggtaacccggttccgggtaccggggggacccgaaaccgggggaccccgtaaccggggttcccgaaccccgggttccctaccccggttccgtaaccggccccgttacccccgaaacccggaaccggggccccctaacggtttccccgggtccccgtttcccccccggtccgggtcccctaacccccgttccccgtaaccccgaaacggaccgccccgtaacccggtccgggttcggggggcccaccggaaccggggcccgggtccccggtcggggccgttccggcccgttaaggggtaacccgg

SEQ ID NO: 373123 - DNA, 637 bp, Homo sapiens
  misc_feature: GZ8MTXP01ATBD1.15.87.H10.1.454.CMB.2.raw
  modified_base (231)..(231): a, c, t, g, unknown or other
  modified_base (288)..(288): a, c, t, g, unknown or other
  modified_base (293)..(293): a, c, t, g, unknown or other
  modified_base (308)..(308): a, c, t, g, unknown or other
  modified_base (349)..(349): a, c, t, g, unknown or other
  modified_base (360)..(360): a, c, t, g, unknown or other
  modified_base (380)..(380): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagttttggatgacctgggtccgccagggtccagggaagggctggagtggtgccaanataaagcaagatggaatgagaaatctatgtggactctgtgaaggccattcaccatcncaganacacgccaagacttngtatcagcaaatgaacagcctagagaggcgaggacaccggntctgtattacngtgcgagtctaccctccgtntcggggcggtaccctacggttttcccaacggcctaagtcgggacggttccggtacgggggacccaaacgggggtacccgaccgggtccaacccgtcctccgtacacgccctacccgaaccgaacgggccccagtcccggtccttcccccgacggcccaacccctccgtacccaacgaacgccgtacccgtacggttcgggggccaccggaacggccccgggtcccgtcggggccttcggcccgttaacggaacccgg

SEQ ID NO: 373124 - DNA, 583 bp, Homo sapiens
  misc_feature: GZ8MTXP01AMW7S.15.87.H10.1.454.CMB.2.raw
  modified_base (299)..(299): a, c, t, g, unknown or other
  modified_base (335)..(335): a, c, t, g, unknown or other
  modified_base (359)..(359): a, c, t, g, unknown or other
  modified_base (468)..(468): a, c, t, g, unknown or other
  modified_base (517)..(517): a, c, t, g, unknown or other
  modified_base (524)..(524): a, c, t, g, unknown or other
  modified_base (531)..(531): a, c, t, g, unknown or other
  modified_base (553)..(553): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaagggctggagtggtgccaacataaagcaagatggaagtgaagaaatactatgtggactctgtgaaggccgattcacatctccaganacaacgccaagaacttatgtatctgacaaatgaacngcctgagaggcgaggacacggctntgtatactgtgcgaggacttaccctcctcgtggggccggtcccgtacggtttccgacggctagtggtacgtcggtcggggaccgaacgggaccgacggtccaccgtccnccgtcacgccctaccgaccgacgggtccacgtccgtcctccccgcgccnccctccncacgacncgaccgtcgttcggggcaccgngccggcccgtggcttcgtccgttgtaaccg

SEQ ID NO: 373125 - DNA, 646 bp, Homo sapiens
  misc_feature: GZ8MTXP01BAXTN.15.87.H10.1.454.CMB.2.raw
  modified_base (325)..(325): a, c, t, g, unknown or other
  modified_base (379)..(379): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgcagggtccaggggaaggggctggagtgggtggccaacataaagcaaagatgggaagtgaagaaatactatgtggactctgtgaagggccattcaccatctccagagacaacgccaaagaacttacngtatctgacaaatgaacagcctgaggaggcgaggacaccggctctgtattacgngtgcgaggactacccgtcctcgtgggcgggtaccgtacgggtttccgtacggcagtggacggtacggtcggggaccgaacggggaccgacggtccgacccgttcctccgtcacggtcccctaccgaacccgaaaccggggcccctacgtcccgggttccccttcccccgtccggtcccctacccctccctacccgaacgaaccgccgacccgtcggttacgggggccaacgcggccgggcccgtcgggcttcgtccgttggtaaccg

SEQ ID NO: 373126 - DNA, 806 bp, Homo sapiens
  misc_feature: GZ8MTXP01EKQLH.15.87.H10.1.454.CMB.2.raw
  modified_base (249)..(249): a, c, t, g, unknown or other
tcagtctacgtagccacgaccggtgctcgatttagcagtactgcgttgggttttccttgttgctattttagaaggtgtccagtgtgaggtgcagttggtggagtcgtggggggaggcttggtccaaccgtgggggggtccctgagactctcctgtgcagcctctggattcattctttaattagtttttggatgaccgtgggtccgcgaggggtccgaggggaaggggctgggaggtggggtgaccaaanaataaaagcaaagagtaggaaagtagaagtaaatactagtggtaggactcgttaggtaggaacggggcccgtaattccaacccatcctaccgaaggacgaacgaaccgacccaaaagtaactttaactgtaactcgtagacaaaatcgaaacacgacctagggaagacggacgaggtaccaccggtctacgtgttaattacgtgagcgagtacctacccgtcgtcggtcggggccgggtccgttacgggtttcccgaacgggtctaaggttcgggaaccggttcgggtacgggggaacccgtaacgggggaacccgtaccgggttacccgaacccggttcctacccgtaccgaaccggtcccctaccccgaacccggaaaccggggtcccctaacggttccccggttccccttaccccccggtggtaccccctcccccgttaacccgtccgttaaacggaccgttaccccggtacccgttaccggggccgggggaccaaccgggccgggcccgggtcccggttcgggggcccttcggtcccgttcggggtaacccgg

SEQ ID NO: 373127 - DNA, 710 bp, Homo sapiens
  misc_feature: GZ8MTXP01C4PWI.15.87.H10.1.454.CMB.2.raw
  modified_base (245)..(245): a, c, t, g, unknown or other
  modified_base (351)..(351): a, c, t, g, unknown or other
tcagtctacgtagccacgaccggtgctcgatttagcagtactgcgttgggttttccttgttgctattttagaaggtgtccagtgtgaggtgcagttggtggagtcgtggggggaggcttggtccaaccgtggggggtccctgagactctcctgtgcagcctctggattcattctttaattagtttttggatgacctgggtcccgccgagggtccaggggaaggggctggagtggggtgaccaaanaataaagcaaagatggaaagtagaagaaaatactagtggtggacttcgtgtaggaagggcctattcaaccatcaccagaacgacaaacgccaaaagtaactttacngtaactcgtagacaaaagtgaaacacgcgtaggaacggaggacggaaggaacctacccgggcttacgtagttaacttacgtggtagcggaagtaccttacccgtcgtcggtcggggccgggtacccgtacggtttaccgacggtacagtcggtacggtcggtacggggacccgaaacggggacccgacggtacctaccgtccctcccggtacgaccgtccctacccgaacccgaaccggccccgtacgttcccggttcccgttcccccgtccggaccctacccctccctaccgaacgcgccgtaccgtcggttacggggcacgcgccggtccgtcggccgttcgtccgttcggtaaccg

SEQ ID NO: 373128 - DNA, 633 bp, Homo sapiens
  misc_feature: GZ8MTXP01DO7DI.15.87.H10.1.454.CMB.2.raw
  modified_base (332)..(332): a, c, t, g, unknown or other
  modified_base (340)..(340): a, c, t, g, unknown or other
  modified_base (468)..(468): a, c, t, g, unknown or other
  modified_base (554)..(554): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcaggttggtggagtcgtgggggaggcttggtccaacgtgggggtccctgagactctcctgtgcagcctctggtattcatctttaatagttttgatgaccgtggccgcgagggtccaggggagggctggagtgggngaccaaanagtaaagcaaagataggaagtgaaagaaatactagtgtaggtaactctggtaggaaacgggcgtacttccaacctagtcctaccgaagaacggaaccaaacggacctaaaagtaactttactagtaanctagaacaaaagtcggaaacagtaccgtaggaaacggaggtacggaaggaaccgtacgggtcttaccgttaggtactttaacgggngtacgagtaacgttactcccgtcgttcgggcgggaccggtaaccttagggttcccgagggcttaggtcgggcgttcggg

SEQ ID NO: 373129 - DNA, 715 bp, Homo sapiens
  misc_feature: GZ8MTXP01D3G0C.15.87.H10.1.454.CMB.2.raw
  modified_base (271)..(271): a, c, t, g, unknown or other
  modified_base (294)..(294): a, c, t, g, unknown or other
  modified_base (299)..(299): a, c, t, g, unknown or other
  modified_base (316)..(316): a, c, t, g, unknown or other
  modified_base (334)..(334): a, c, t, g, unknown or other
  modified_base (355)..(355): a, c, t, g, unknown or other
  modified_base (361)..(361): a, c, t, g, unknown or other
  modified_base (372)..(372): a, c, t, g, unknown or other
  modified_base (395)..(395): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgacctgggtccgcagggtccagggaagggctggagtgggtgaccaacataaagcaagatggaagtgaagaaatactatggngactctgtgaaggcatcacatcncaganacacgcaaagacttctntatcagacaaaatgaacngcctaggaggaggcgaggacncggctntgtacttacgngtgcgaagcttaccctcgtcggnggggcgggtccgtacggtttccgtacggcgtagtcggacggttcggtacggggaccgaacgggaccgaccggtccgtaacccgttcctcccgtacgaccgtaccccgtacccgaacccgtaaacccgggccccgtaacgttccccgggttccccgtttccccccggtccggtaccccctacccccgtaaccccttaacccgaaacggtacccgacccgtaacccggttccgggttaaccggggggccaaacccgggccgggtccccgggccccgggttcggggtcccgttcgggtcccggttaacggttaaaccccgggg

SEQ ID NO: 373130 - DNA, 631 bp, Homo sapiens
  misc_feature: GZ8MTXP01AVBBA.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggagcttggtccaaccgtgggggtccctgagactctcctgtgcagcctctggattcattctttaatagttttggatcgaccgtgggtccgcgagggtccgaggggaggggctgggagtgggtggaccaagataaagcaaagataggaaagtgaaagtaaatactaagtgtaggaaaccttgtggtaggaacggggtccctacttaccaaccctattaccctacccgaaggaaacaaccgtaaccggaccaaaaggtaaaccctttcgtagtaactctaagactaaagtaagaacgacgaccgagaggaggacgacggacgacgcgtcctagtattaacgtgtgacggacggttacgtacctccgttcgttcggccgggtccgtacggttccgtcggtcgacgcggaacgtccggg

SEQ ID NO: 373131 - DNA, 668 bp, Homo sapiens
  misc_feature: GZ8MTXP01DG9KB.15.87.H10.1.454.CMB.2.raw
  modified_base (570)..(570): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtcagtgtgaggtgcaggttggtggagtcgtgggggagcttggtccaaccgtggggggtccctgagactctcctgtgcagcctcgtggtattcattactttaatagtttttggatgaccgttgggtcccgccgagggtccgaaggggaaggggctggggagtggggtacgaccaacgaataaaagcgaaagagtaggaaagtgaaagaaatactagtggtggaacttgtggtaggaaacggggcctattccactatcctaccaagacgaaccaaacggacctaaaagtaaactttacgtagtactcgtagaactaaaatcggaaactaacggccgttaaggaacgggaggacggaacggaacgaaccggtctcgttagtaccgtttanggtaggacgtaacggactttacccgtcgttacggttcgggacccggtcctaacgggttttcccgaacggtcgttaacgttcggggaaccgttccgggg

SEQ ID NO: 373132 - DNA, 707 bp, Homo sapiens
  misc_feature: GZ8MTXP01DIPMZ.15.87.H10.1.454.CMB.2.raw
  modified_base (240)..(240): a, c, t, g, unknown or other
  modified_base (303)..(303): a, c, t, g, unknown or other
tcagtctacgtagccacgaccggtgctcgatttagcagtactgcgttgggttttccttgttgctattttagaaggtgtccagtgtgaggtgcagttggtggagtcgtggggggaggcttggtccaaccgtgggggggtccctgagactctcctgtgcagcctctggattcattctttaatagtttttggatgacctgggtccgccgagggtccaggggagggctggagtgggtgaccaanataaagcaagatggaaagtgaagaaatactatgtggactctgtagaagggccgatcaccatcnccagagaacaacgaccaaagaactttactgtatctgaacaaatcgaaacagcctaggaggaggcgaaggtaccaccgggtctacgttagtattacgtgtagcgaggtacttaccctcccgtggtcggggccgggtacccgtacggtttacccgtacgggctacgtcgggtacggtcgggttacgggggaccgaaacggggacccgaccgggtaccctacccggttcctcccgttacgaccgccctaccccgaaccgtaaaccgggccctaacgtcccggttcccttcccccgtcggaccccacccctcctacccgaaacgaccgttcccgacccgtcggccgggggcaacccggaacggccccggtcccggtcggggtccttcgggtcccgttcgggtaacccg

SEQ ID NO: 373133 - DNA, 630 bp, Homo sapiens
  misc_feature: GZ8MTXP01BLKLS.15.87.H10.1.454.CMB.2.raw
  modified_base (296)..(296): a, c, t, g, unknown or other
  modified_base (301)..(301): a, c, t, g, unknown or other
  modified_base (320)..(320): a, c, t, g, unknown or other
  modified_base (340)..(340): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatctttaatagtttttggatgacctgggtccgccagggtccaggggaaggggctggagtgggtggccaacataaagcaaagatggaagtgaagaaatactatgtggactctgtgaaggccatcacatcncaganacaacgccaaagacttacngtatctagcaaaatgaaacngcctgagacggcgaggtacaccggctctgtattactgtgcgaggactaccctccgtcgtcgggccgggtccctagggtttcccgtacggcagtcgggacgtcggtcgggggaccgaacggggaccgaccgggtcaccgtcctccgtccgacgccctaccgaccgaacgggccccacgtccggttcccttcccccgtggcccctcccctcctacccgaagaccgccgtaccctcgggcgggggccacggaacggccggcccgttggggccttcgggcccgttgggtaaccg

SEQ ID NO: 373134 - DNA, 619 bp, Homo sapiens
  misc_feature: GZ8MTXP01CTZ24.15.87.H10.1.454.CMB.2.raw
  modified_base (331)..(331): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattctttaatagtttttggatgacctgggtccgccagggtccaggggaaggggctggagtgggtggccaacataaagcaaagatggaagtagaagaaaatactatgtggactctgtggaagggccgattcaccatctccagagacaacgccaaagaacttacngtatctgacaaatgaacagcctgagaggcgaggacacggctctgtattacgtgtgcggagactacctctcgtgggcggccgtacggtttccgacggctagtcggacgtcggtcggggaccgaacggggaccgacgtccacgtcctcgtcacgccctaccaccgaaccggcccgtactcccggtcccttccccgtcggccctccccgtcctaccgacgtacgcccgtaccgtcggttcggggccaccgaacggcccggcccgtcgggccttcggtccgttcggtaaccg

SEQ ID NO: 373135 - DNA, 644 bp, Homo sapiens
  misc_feature: GZ8MTXP01DSD40.15.87.H10.1.454.CMB.2.raw
  modified_base (299)..(299): a, c, t, g, unknown or other
  modified_base (371)..(371): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgcagggtccaggggaaggggctggagtggggtggccaaacataaagcaaagatggaaagtgaagaaatactaatgtggactctgtgaagggccatcacatcnccagagacaacgccaaagaacttactgtatctagacaaaatgaaacagcctagagaggcgaggacacggctntagtattacgtgtgcgagacttacctcctcgtaggggccgggtaccgtacgtttcccgacggcacgtcggaccggtcggtacggggaccgaacggggacccacgggtccaccgtcctccgtcacgccctacccgaccgaacggcccacgtcccggttcccttcccccgtcggccctacccctccctacccgaaacgccgccgaacccgttcgggccgggggccaccgaacgggcccggcccgtcggggtccttcggtcccgttgggtaacccg

SEQ ID NO: 373136 - DNA, 601 bp, Homo sapiens
  misc_feature: GZ8MTXP01DHEMV.15.87.H10.1.454.CMB.2.raw
  modified_base (238)..(238): a, c, t, g, unknown or other
  modified_base (306)..(306): a, c, t, g, unknown or other
  modified_base (325)..(325): a, c, t, g, unknown or other
  modified_base (329)..(329): a, c, t, g, unknown or other
  modified_base (367)..(367): a, c, t, g, unknown or other
  modified_base (376)..(376): a, c, t, g, unknown or other
  modified_base (393)..(393): a, c, t, g, unknown or other
  modified_base (414)..(414): a, c, t, g, unknown or other
  modified_base (507)..(507): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattcttttaatagtttttggatgacctgggtccgcaggggtccagggaaggggctggagtgggtgccaanataaagcaaagatggaaagtgaagaaatactatgtggactctgtgaagggccattcaccatctcaganacaacgcaaagaacttacngtanctgacaaatgaaacagcctgagaggcgagacacggctntgtatacgngtgcgagactacctccngtgggcggcagttccacggcngtggacgtcgtcggggaccaagggaccacggtcaccgtctcctcacgccctaccaccgaacggcccagtccggtcccttccccgtcggacccnccccgtccctccgaaacgcgaccaacccgtcgggttacgggggccaccgaacggcccggtcccgtcgggggcttcggcccgtttgggtaacccg

SEQ ID NO: 373137 - DNA, 811 bp, Homo sapiens
  misc_feature: GZ8MTXP01DWJX0.15.87.H10.1.454.CMB.2.raw
  modified_base (313)..(313): a, c, t, g, unknown or other
  modified_base (316)..(316): a, c, t, g, unknown or other
  modified_base (321)..(321): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcattctttaatagttttttggatgaccgtgggtcccgcgagggtccaggggaaggggctggaggtggggtggaccaaacaataaagcaaagatagggaagtagaagaaaattactatggtggactcgtgtaggaagggcgattcacntcncaganacaacgcaaagtacttatgtatctgacaaatcgaaacacgccgtaggaggacgggcggaaaggaccgaccggtccttacgttaggttaactttaccgtgggttacgaaccgggtaaagggtacttccggtccccgttcccgtacgggttcgggggacccgggtcccgtttaacgggtttcccgtacgggacctaaggttcggggtaaccggttcgggtacgggggacccgaaacggggacccgaccggttaccgtaaccccggttccttccccgtcgaccggtacccccttacccggaaccccgaaaccggggtcccctaacggttccccgggttaccccttccccccggttacggccccttaaacccccgttcccttacccgaaacgggaaccgtcccgtaacccgtttccggggccgggggaccaaccggaccgggccccgggtccccgggttgggggcccttccgggttaacccggtttcccggggg

SEQ ID NO: 373138 - DNA, 652 bp, Homo sapiens
  misc_feature: GZ8MTXP01BDDGQ.15.87.H10.1.454.CMB.2.raw
  modified_base (239)..(239): a, c, t, g, unknown or other
  modified_base (302)..(302): a, c, t, g, unknown or other
  modified_base (391)..(391): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattcttttaatagtttttggatgacctgggtccgcagggtccaggggaagggctggagtgggtggccaaanataaaagcaaagatggaaagtgaagaaatactatgtggactctgtgaagggccattcacatcnccagagacaaacgccaaagaactttactgtaactctagacaaaatgaaacagcctaggaagaggcgaggacaccggctactgtattacngtgcgaggactaccctccgtcgtcgggccgggtcctacggtttccgaacggtcagtgggacgtcggtcggggaccgaacggggaccgacggtcgaccgttcctccgtacgacgccctacccgaaccgaacgggccccacgttcccggtcccttcccccgtcggccctacccctcccgtacccgaaacgacgaccaacccgtcggttcgggggccacgaacgggtcccggcccgtcggggccttcggcccgttgggtaaccg

SEQ ID NO: 373139 - DNA, 773 bp, Homo sapiens
  misc_feature: GZ8MTXP01CZLW1.15.87.H10.1.454.CMB.2.raw
  modified_base (292)..(292): a, c, t, g, unknown or other
tcagtctacgtagccacgaccggtgctcgatttagcagtactgcgttgggttttccttgttgctattttagaaggtgtccagtgtgaggtgcagttggtggagtcgtggggggaggcttggtccaaccgtgggggggtccctgagactctcctgtgcagcctctggattcattcttttaattagtttttggatgaccgtgggtcccgccgagggtccaggggaagggctggagtggggtgaccaaacaataaaagcaaagagtaggaagtagaagaaatactatgtggactntgtggaagggccatcaccatctaccagacgacaaacgccaaagtaacttactgtatctagacaaaatgaaacacgtccgtaggaaaggacgggacggaagggaccgacccgggtcttacgttaggttaactttacgtgggtacgccggtaaaggtaccttaccctccgttcggtcgggggtccggggtacccgtacgggtttcccgtaccgggtacgtacggttacgggtaccggtacgggtaccgggggtaaccggaaaccgggggtaacccgtaccgggtacccgtaacccggttccctaccccgttcccgaccggtacccctacccgaacccggaaacccgggccccgtacggttcccggttccccttcccccgtcggcccctaccccgtccctaccgaacggaccgccgtacccgtcggttacgggggcaccggaaccggcccggcccggtcgggcgttcggtccgttcggtaaccg

SEQ ID NO: 373140 - DNA, 832 bp, Homo sapiens
  misc_feature: GZ8MTXP01B60M0.15.87.H10.1.454.CMB.2.raw
  modified_base (328)..(328): a, c, t, g, unknown or other
  modified_base (333)..(333): a, c, t, g, unknown or other
  modified_base (346)..(346): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcattctttaatagtttttggatgacctgggtccgcgagggtccaggggaaggggctgggagtgggtggccaaacataaagcaaagatggaagtgaagaaatctatgtggactctgtggaagggccattcaccatctaccagagacaacgaccaagacttacngtatntgacaaatgaacngcctggagaggcgaggacaccggctctgtacttctgtacgcggaagtactaccctccgtcggtcggggtccgggtacccgttacgggtttacccgtaccgggtacgtaacggttcggggtaacccggttacgggtaccggggggaacccgtaaaccgggggaccccgtaccgggggtaccctaacccgggttccccttccccgttacccgacccggtacccccgtaccccgaaaccccggaacccgggggcccccttaacggttccccggttccccctttcccccccggtaccgggtaccccctacccccgttaaccccgtacccgaaaccgggtccgaaccccggtaaccccggttccggggttacccggggggggacccaaaccccggggtaaccgggggcccccccggggtaaccccgggttcccgggggtaccccggtttccgggtaacccccgggttaacgggggtttaaaacccccgggg

SEQ ID NO: 373141 - DNA, 680 bp, Homo sapiens
  misc_feature: GZ8MTXP01C92BQ.15.87.H10.1.454.CMB.2.raw
  modified_base (301)..(301): a, c, t, g, unknown or other
  modified_base (306)..(306): a, c, t, g, unknown or other
tcagtctacgtagccacgaccggtgctcgatttagcagtactgcgttgggttttccttgttgctattttagaaggtgtccagtgtgaggtgcagttgttggagtctggggggaggcttggtccaaccgtgggggggtccctgagactctcctgtgcagcctctggattcattctttaatagtttttggatgacctgggtccgccagggtccaggggaagggctggagtgggtgccaacataaagcaaagatggaagtgaagaaatactatgtggactctgtagaagggccattcaccatcncaganacaacgccaaagaacttactgtatctagacaaatcgaaacagcctaggaaggacggcggaaggaccaccgggtcttacgtgttaacttacgtggttacgcggtaaaggtaccttaaccccgtccgtcggtcggggacccggggtaccgtacggtttcccgtacggctagtcgggtacggtcggtacgggggaccgaacggggaccacggtcctaaccgtcctccgtaccacgtccctacccgaaccgaaccggccctacgtcccggtcccttcccccgtcgccctacccctaaccctccgaaacgacgccgtaaccgtcggttacgggggcaaccgcggcccggcccgtcgggccttcgtccgttcggtaaccg

SEQ ID NO: 373142 - DNA, 668 bp, Homo sapiens
  misc_feature: GZ8MTXP01CU5N2.15.87.H10.1.454.CMB.2.raw
  modified_base (361)..(361): a, c, t, g, unknown or other
  modified_base (376)..(376): a, c, t, g, unknown or other
  modified_base (579)..(579): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagcttgggttttccttgttgcttattttagaaggtgtccagtgtgagtgcagttggtggagtcgtgggggaggcgttcggtccgaaccgtggggggtccctggacgtactctccgtgtgcacgtcctcgtggtattctattacttttaaattaggtttttggatcggtaccgtcggggtccgccgagggtccgagggggaggggcgtggggnggtgggtggaccaanataaagacgaagataggaagtagaagtaaatactagtaggtggtaaacttcgtggtacgggtaacgggccggtattaccgaccctactaccgtaccaaaggacgaaaccgaaaccgaccaaagtaaaccttttactagttactcgtagaacaaagtcgaaacgagccgtaggacggacgggccgagggacacgggtctacgtntaccgtgtgtgcggtagaccttcccgtcgttcgttcgggacgggtcctacggtttccccgagggtaccttgtcggggcgtaaccggggg

SEQ ID NO: 373143 - DNA, 813 bp, Homo sapiens
  misc_feature: GZ8MTXP01D9870.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccaggggaagggctggagtgggtggccaacataaagcaagatggaagtgaagaaatactatgtggactctgtgaaggccgattcaccatctcagagacaacgccaagacttactgtatctagcaaatcgaacagcctgagaggcgaggacaccggctctgtattacgtgtcgcgaggtataccctccgtcgtcggggccggggtacccgtacgggtttacccgttaccgggcgtaacgtcgggtaccggttccggtacggggggtacccgaaaccggggggaacccgtaacccggggttacccgtaaaccccgggttccccgttaaccccggttccccgtaaacccgggtcccccgtttacccccgaaacccccggtaaaaccccgggggtaccccccgtaaaccggtttacccccggggtttccccgtttcccccccccggttacccgggtccccgtaaacccccccggttcccccttaccccgaaaccggtaaacccgggccctaaaccccggttcccgggttcgggggggttcccaccgggaaccgggccccggggtccccgtcgggggtcccgttcgggtaaccccgttccggggttaacccgg

SEQ ID NO: 373144 - DNA, 564 bp, Homo sapiens
  misc_feature: GZ8MTXP01ALZDI.15.87.H10.1.454.CMB.2.raw
  modified_base (418)..(418): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtgggggtccctgagactctcctgtgcagcctctggattctatctttaatgtttttggattgacctgggtccgccgagggtccgaggggaggggctgggagtgggtggaccaacgataaagcaaagagtaggaaagtgaagaaatatagtgtgaactctggtgaagggccattcacatctcaganacacgacaagtaacttatgtatctagacaaagtagaacgagccgtagaggaggcgagacgacggctcgtagtattacgtgtgcggaaggttcctaccgtcttcggttcggccgggtcctagggttcccaggcagtcgggcgtcggg

SEQ ID NO: 373145 - DNA, 686 bp, Homo sapiens
  misc_feature: GZ8MTXP01A50IB.15.87.H10.1.454.CMB.2.raw
  modified_base (234)..(234): a, c, t, g, unknown or other
  modified_base (335)..(335): a, c, t, g, unknown or other
  modified_base (341)..(341): a, c, t, g, unknown or other
  modified_base (382)..(382): a, c, t, g, unknown or other
  modified_base (393)..(393): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattctttaatagtttttggatgacctgggtccgcgagggtccagggagggctggagtggtgccaanataaagcaagatggaagtgaagaaatactatgtggactctgtggaacgggcctattcaaccatcctaccgagaacgactaaacgccaaagtaacctttacngttacncgtagacaaatgaacagcctaggagagcggtagacaccggntctgtattcgngtgcgaggtacctacccgtcgtcgtacggggcgggtccgtacggttaccgtacggtcgtagtcggtacggtacgggtcggggacccgaaacggggacccgaaccgggtccacccgtcccgtccgtccgaccgccccttacccgaaccggaaacccgggcccctacgttcccggttcccgttcccccgtcggtccccaccccgttccctaacccgaacgtccgccgtaccgtcggttacgggggccaccggaacggcccggcccggtcgggccgttcgtccgttcggtaacccg

SEQ ID NO: 373146 - DNA, 692 bp, Homo sapiens
  misc_feature: GZ8MTXP01BY7GQ.15.87.H10.1.454.CMB.2.raw
  modified_base (235)..(235): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattctttaatagtttttggatgacctgggtccgcagggtccagggaagggctggagtgggtgccaanataaagcaagatggaagtgaagaaatactatgtggactctgtgaagggccattcacatctaccagagacaacgccaaagaacttactgtatctgacaaatgaacagcctaggagaggcgaggacaccggctcgtagtatttacgtggtcgcggaaggtactacccctccgtcggtcgggggccgggtacccgtacgggtttcccgtaccgggtctacggtcgggtacggtcggtacgggggacccgaaacggggacccgaccgggtccgacccgttcctcccgtcgaccgccctacccgaacccgaaccgggcccctacgttcccggttcccttcccccgtcggccccaccccgtccctaacccgaacggtaccgccgaacccgttcggccgggggccgaccggaacgggcccgggtccccggtcggggccgttccggtcccgttcgggtaacccgg

SEQ ID NO: 373147 - DNA, 681 bp, Homo sapiens
  misc_feature: GZ8MTXP01B6M32.15.87.H10.1.454.CMB.2.raw
  modified_base (278)..(278): a, c, t, g, unknown or other
  modified_base (303)..(303): a, c, t, g, unknown or other
  modified_base (364)..(364): a, c, t, g, unknown or other
  modified_base (374)..(374): a, c, t, g, unknown or other
tcagtctacgtagccacgaccggtgctcgatttagcagtactgcgttgggttttccttgttgctattttagaaggtgtccagtgtgaggtgcagttggtggagtcgtgggggaggcttggtccaacctggggggtccctgagactctcctgtgcagcctctggattcattctttaatagtttttggatgaccgtgggtccgcgagggtccgaggggaaggggctggagtgggtgccaaacataaagcaagatggaagtgaagaaatactatgtgactntgtgaaggccattcacatctcaganacaacgccaaagaacttactgtatctgacaaatgaacagctgagaggcgaggacacggctntgtatactgngcgaggtactaccctcgtgtcggggccgggtcctacggtttccgacggctagtcggacgtcggtacggggaccgaaacgggacccgaccggtccaacccggtcctccctcgaccgtccctacccgaacccgaaccggccccgtacgttcccggtcccctttccccccgcggtcccctacccccgtccctaccccgaaacggccgacccgtacccgttccgggttcggggggcccaaaccgggccggccccggggtccccggttgggggccccgttaccgggtccccggttaacggggtaaaccccgg

SEQ ID NO: 373148 - DNA, 654 bp, Homo sapiens
  misc_feature: GZ8MTXP01AJBI4.15.87.H10.1.454.CMB.2.raw
  modified_base (562)..(562): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcaggttggtggagtcgtgggggaggcttggtccgaaccgtggggggtccctgagacctctcctgtgcagcctcgtggacttctattctttaatagttttggatgtaccgtgggtcccgcgagggtccgaggggaggggctgggagtgggtgaccaagataaagcaagataggaagtagaagtaaatactagtgtaggaactcgtggtaggaaacgggtcccgtattccgacctatcctacccgaaggaacgaacaaacccggaccaaaacggtaaccttaccgtgtactaccgtagaaccaaagtgaaaccgtgacccgtaggaacgggaggccggacggaccgcggtctcgtagtaacttcggnggtcgacggacggttacttcccctccgttcggttccggggccggtaaccgtacgggttcccgtacggcgttaggtccgggaacgtccggggg

SEQ ID NO: 373149 - DNA, 568 bp, Homo sapiens
  misc_feature: GZ8MTXP01C9PE4.15.87.H10.1.454.CMB.2.raw
  modified_base (232)..(232): a, c, t, g, unknown or other
  modified_base (455)..(455): a, c, t, g, unknown or other
  modified_base (463)..(463): a, c, t, g, unknown or other
  modified_base (497)..(497): a, c, t, g, unknown or other
  modified_base (502)..(502): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgcagggtccagggagggctggagtggtggccaanataaagcaagatggaagtgaagaaatactatgtggactctgtgaagggccgattcaccatctccagagacaacgccaaagaacttactgtatctgacaaatgaaacagcctgagaggcgaggacaccggctctgtattactgttgcgagactacctctcgtgggcggccgtagtttccacggcaagtggacgtcgtggggccaagggaccacggtcaccgtcnccgtcacncctccaccgaacggcccagtccggtccttccccnggccnccctcctccgaagcgcacctcgttggggccacgaacggcgcccgtgggcttcgtccgttggtaacg

SEQ ID NO: 373150 - DNA, 679 bp, Homo sapiens
  misc_feature: GZ8MTXP01APZ2T.15.87.H10.1.454.CMB.2.raw
  modified_base (251)..(251): a, c, t, g, unknown or other
  modified_base (322)..(322): a, c, t, g, unknown or other
  modified_base (360)..(360): a, c, t, g, unknown or other
  modified_base (383)..(383): a, c, t, g, unknown or other
tcagtctacgtagccacgaccggtgctcgatttagcagtactgcgttgggttttccttgttgctattttagaaggtgtccagtgtgaggtgcagttggtggagtcgtggggggaggcttggtccaaccgtgggggggtccctgagactctcctgtgcagcctctggattcattcttttaattagtttttggatgaccgtgggtcccgccgagggtccgaggggaaggggctggaggtggggtggaccaaanaataaaagcaaagagtaggaagtagaagaaatactatgtggactctgtgaagggccatcacatctccaganacaacgccaagacttactgtactctgacaaatcgaacngctggagagcgagacgacggctntgtatacgtgtcgcgaggtactaccctccgtcgtcgggccgggtcccgtacgggtttccctacgggctaggtacgggacgtacggtcgggggaccgaaacggggacccaccgggtccaccgtcctccgtcgaccgcccctacccgaaacccgaaccggggtcccctacgttcccggttcccgttacccccgtcggcccctacccctccctacccgaaacgacgcccgacccgtcgggttcgggggccaacggccggccgggcccgtcgggccgttcggtcccgttgggtaacccgg

SEQ ID NO: 373151 - DNA, 614 bp, Homo sapiens
  misc_feature: GZ8MTXP01AMJNG.15.87.H10.1.454.CMB.2.raw
  modified_base (322)..(322): a, c, t, g, unknown or other
  modified_base (340)..(340): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccaggggaagggctggagtgggtggccaacataaagcaaagatggaatgaagaaatactatgtggactctgtgaagggccattcaccatctccagagacaacgccaagaactttacngtatctgacaaatgaacngcctggagaggcgaggacaccggctcgtgtacttacgtgtgcgaggactaccctcgtcgtcggggccgggtcctacggtttccgtacggcagtcgggacgtcgtcgggggaccgaacgggacccgacggtccaccgtcctccgtcacgcctacccgaccgaacggcccacgtccggtcccttcccccgtcggccctaccccgtcctccgaacgacgccgacccgtcgttcgggggcacgcggccggcccgtgggccttcgtccgttggtaaccg

SEQ ID NO: 373152 - DNA, 647 bp, Homo sapiens
  misc_feature: GZ8MTXP01CHDQ8.15.87.H10.1.454.CMB.2.raw
  modified_base (293)..(293): a, c, t, g, unknown or other
  modified_base (319)..(319): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgcagggtccagggaaggggctggagtgggtggccaacataaagcaaagatggaagtgaagaaatactatgtggactctgtgaaggcattcacatcnccagagacaacgccaaagaacttacngtatctgacaaatgaacagcctgagaggcgaggacaccggctcgtgttattactgtgcgaggtactacccgtccgtcgtcggggcgggcccgtacgggtttccgtacgggctagtcgggaccggtcggtcggggacccgaacggggacccgacggtccgacccgtacctcccgtcacggccctacccaccgaacggccccacgtcccggtcccttcccccgtcggccctcccctccctacccgacggaccgccgtacccgtcggttcgggggccaccggaacggcccgggcccgttcggggccgttcggtcccgttcgggtaacccgg

SEQ ID NO: 373153 - DNA, 612 bp, Homo sapiens
  misc_feature: GZ8MTXP01E2TAH.15.87.H10.1.454.CMB.2.raw
  modified_base (292)..(292): a, c, t, g, unknown or other
  modified_base (295)..(295): a, c, t, g, unknown or other
  modified_base (318)..(318): a, c, t, g, unknown or other
  modified_base (325)..(325): a, c, t, g, unknown or other
  modified_base (361)..(361): a, c, t, g, unknown or other
  modified_base (371)..(371): a, c, t, g, unknown or other
  modified_base (544)..(544): a, c, t, g, unknown or other
  modified_base (561)..(561): a, c, t, g, unknown or other
  modified_base (583)..(583): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattcttttaatagtttttggatgacctgggtccgccagggtccgagggaagggctggagtggtgccaaacataaagcaagatggaagtgaagaaatactatgtgactctgtgaaggcatcacntcncagagacaacgcaaagaacttangtatctnacaaaatgaacagctagagaggcgaggacacggctntagtattacngtgcgagactaccctcctcgtggggccggaccgtacggtttcccgtacggcgagtcggacggtcggtacggggaccgaacggggacccgaccggtaccaacccgttcctaccctcaccggccctacccaacccgaaccgggccctacgtcccggtcccttccccgtcggcccncccctcctaccaagacnccgaaccgtcggcggggcacgnggcccgccgtggcttcgtccgcggtaacg

SEQ ID NO: 373154 - DNA, 614 bp, Homo sapiens
  misc_feature: GZ8MTXP01BASEL.15.87.H10.1.454.CMB.2.raw
  modified_base (235)..(235): a, c, t, g, unknown or other
  modified_base (305)..(305): a, c, t, g, unknown or other
  modified_base (374)..(374): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgcagggtccaggggaagggctggagtgggtgccaanataaagcaaagatgggaagtgaagaaatactatggtggactctggtgaacgggcattcaccatctcaganacaacgccaagtaactttactgtaatctgacaaaatgaaacagcctaggagaggcgaggacaccggctntgtatctgtgcgagactccctcctgtcggggacggtccgtacggtttcctacggcagtggacgtcgtgggccgaagggaccacgtcacgtcgtaccgtcacgccctaccgaccgaacggcccacgtcccggtcccttccccgtcggcccctaccccgtccctaccaacggaccgccgtaccgtcggttcgggggccacgcggcccggcccgtcggggccttcggcccgttcgggtaaccg

SEQ ID NO: 373155 - DNA, 714 bp, Homo sapiens
  misc_feature: GZ8MTXP01C8DZY.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattctttaatagtttttggatgacctgggtcccgccgagggtccgaggggaaggggctgggagtggggtggaccaaacataaaagcaaagatggaagtgaagaaatactatggtggactctgtggaagggccattcaccatctaccagacgacaacgaccaaagtaactttactgtatctagactaaaatcgaaacacgcctaggaggaggcgaaggacctacggctacttgtaattacgtgtgcgagactaccctccgtcgtgggccgggcctacgtttccgacggcgtagtggacggtacggtacggggaccgaacggggaccgacggtccgaccgtccgtccgtccgaccgccctacccgaaccgaaccgggcccctaacggttcccggtccccttcccccgtccggtacccctacccccgttcccctaacccgaaacgaccgcccgtaacccgtcgggttccgggggacccaccgggaacccgggccccggggtccccgtcgggggtcccgttccgggtcccggttccggggttaaacccgg

SEQ ID NO: 373156 - DNA, 581 bp, Homo sapiens
  misc_feature: GZ8MTXP01AKJRM.15.87.H10.1.454.CMB.2.raw
  modified_base (225)..(225): a, c, t, g, unknown or other
  modified_base (231)..(231): a, c, t, g, unknown or other
  modified_base (243)..(243): a, c, t, g, unknown or other
  modified_base (510)..(510): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgcagggtccagggagggctggagtggngccaanataaagcaaagntggaagtgaagaaatactatgtggactctgtgaagggccgattcacatctcagagacaacgccaagacttactgtatctgacaaaatgaacagcctggagagcgaggacaccggctctgtatactgtgcgagactacctctgtggccggccgtacggtttccgtacggcagtggacgtcggtacgggccgaacgggaccgacggtcgaccgtcctccggtcacgccctcccgaccgaacggcccacgtccgtccttccccgtcgccnccctcctccagacgccacgtcgttcgggggcacgaagccggcccgcgggcgttcgaaccgttcggtaaccg

SEQ ID NO: 373157 - DNA, 706 bp, Homo sapiens
  misc_feature: GZ8MTXP01CODWR.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtgggggtccctgagactctcctgtgcagcctctggattcattctttaatagttttggatgaccgtgggtccgccgagggtccgaggggaggggcgtgggaggtgggtgaccaacaataaaggcaaaggagtaggaagtagaagaaatacgtagtgtaggaaacttcgtggtaggaaacggggccctattccgaacctactcctacccgaagaacgaaccaaacggaccctaaaaggtaaaccttttaccgtaggttaactacgtacgaactaaaagttcggaaaaccgcggtacccgtagggaacgggaacgggacggaacgggaccaacccggggcttcgtagttaactttccgtaaggttcgacgggtaacggttaccttaccccgttccgttccggttcgggggaccccgggttccctacgggttttccccgacgggtcgttaacgttcggggaaccgtttcccggggg

SEQ ID NO: 373158 - DNA, 695 bp, Homo sapiens
  misc_feature: GZ8MTXP01EC7ZO.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagcttgggttttccttgttgcttatttagaaggtgtccagtgtgaggtgcagttggtggagtcgtgggggaggcgttggtccgaaccgtgggggtccctgagactctcctgtgcagcctctggattcattctttaatgttttggatgaccgtgggtccgcgacgggtccgaggggaggggcgtagggaggtggggtaggaccaaagaagtaaagacgaaaggtagtagggaaaggtagaaagaaatacgtaagtgtcggtaactcgtggtaggaacgggcccgtattacccgacctagtcctaccgaagaacgaaccgaaaccgtaccgtaaaacgtaactttacgtagttaactctagaaactaaaatacgaaacgacggtaccgtagggaacggaacggccggaagggaccgaacgggtccttacgttagttaagttaccgtggtacggacggtaacggttacctacccgtccgttacgggttccgggttccgggtaacccgttacggtttcccgtacggacgaggtcgggaaccgttccgggg

SEQ ID NO: 373159 - DNA, 593 bp, Homo sapiens
  misc_feature: GZ8MTXP01EO4XP.15.87.H10.1.454.CMB.2.raw
  modified_base (273)..(273): a, c, t, g, unknown or other
  modified_base (298)..(298): a, c, t, g, unknown or other
  modified_base (371)..(371): a, c, t, g, unknown or other
  modified_base (518)..(518): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgccagggtccagggaagggctggagtgggtggccaacataaagcaagatggaagtgagaaatactatgtgactntgtgaagggcattcacatctcaganacaacgccaaagaacttactgtatctagcaaaatgaacagctgagagcgagacaccggctctgtatactgtancgagataccgtcctgtggggcggtctaggtttcccacggtcaacgtggtacggtcgtagggggaccaaaggggaccacgggtcaccgtcctccgtacacgccctccgaaccgacgggaccccagtcccgtccttcccccgtcggccnccccgtcctccgaagaacgccaacctcggttcgggggcacgaagcccggctcggggcttcggtccttggtaaccg

SEQ ID NO: 373160 - DNA, 587 bp, Homo sapiens
  misc_feature: GZ8MTXP01DDLJ2.15.87.H10.1.454.CMB.2.raw
  modified_base (234)..(234): a, c, t, g, unknown or other
  modified_base (339)..(339): a, c, t, g, unknown or other
  modified_base (373)..(373): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgcagggtccaggggaagggctggagtgggtgccaanataaagcaagatggaagtgaagaaatactatgtggactctgtgaagggccattcacatctccagagacaacgccaaagaacttactgtatctagacaaatgaacngcctgagaggcgaggacacggctcgtgtattacngtgcgagtactaccctctcgtgggccgggtctacggtttccgtacggcgtagtggacggtcggtcggggaccgaacgggaccgacggtccaccgtcctccgtcacgcctccaccgacggcccacgtccgtccttccccgtcgcccaccctcctaccgaacgacgccgaccgtcgcggggcacgcgccggccgtcggcttcgtcgttcggtaacg

SEQ ID NO: 373161 - DNA, 671 bp, Homo sapiens
  misc_feature: GZ8MTXP01BNJ4G.15.87.H10.1.454.CMB.2.raw
  modified_base (245)..(245): a, c, t, g, unknown or other
  modified_base (304)..(304): a, c, t, g, unknown or other
  modified_base (309)..(309): a, c, t, g, unknown or other
  modified_base (334)..(334): a, c, t, g, unknown or other
tcagtctacgtagccacgaccggtgctcgatttagcagtactgcgttgggttttccttgttgctattttagaaggtgtccagtgtgaggtgcagttggtggagtcgtggggggaggcttggtccaaccgtgggggggtccctgagactctcctgtgcagcctctggattcattctttaattgtttttggatgaccgtgggtccgccgaggggtccaggggaaggggctggagtgggtggaccaanataaagcaaagatggaagtgaagaaatctatgtggactctgtgaacgggcatcacatcncaganacaacgccaaagtaacttactgtanctagacaaatgaacagcctaggagaggacgacggacaccggcttacgtgttattacgtggtacgcggagtactacccgtccgtcggtcgggggccggtcccgtacggtttaccgtacggacgtacgtcgggtacggtaccggtacggggtaccgaacgggacccgacggtccgtacccgtccgtccgtcgaccgccccacccgtaacccgaaccggtcccgtacgttcccggtcccgttccccgtcgccccgtcccctccctaccgaacgaccgccgtaccgtcgttcggggccacggcggcccggccgtcgggcgttccggtccgttcggtaaccg

SEQ ID NO: 373162 - DNA, 599 bp, Homo sapiens
  misc_feature: GZ8MTXP01AXFUY.15.87.H10.1.454.CMB.2.raw
  modified_base (231)..(231): a, c, t, g, unknown or other
  modified_base (324)..(324): a, c, t, g, unknown or other
  modified_base (341)..(341): a, c, t, g, unknown or other
  modified_base (376)..(376): a, c, t, g, unknown or other
  modified_base (533)..(533): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattcttttaatagtttttggatgacctgggtccgcagggtccaggggagggctggagtgggngaccaacataaagcaagatggaagtgaagaaatctatgtggactctgtgaagggccattcgcatctacagagacaacgccaaagaactttacngtatctgacaaatgaancgctgacgaggcaggacaccggtctactgtattcngtgcgagactacccctcgtcgtcggggcggtccctacggtttccgacggcagtcggacgtcggtggggaccaacgggaccgacggtccaccgtccgtacctcgtacgcctacccgaaccgaaccggcccacgttccggtcccttccccgtccgcccncccctcctaccgacgcaccgccgtcgcggggcacgcggccgccgtgggcttcgccgttggtaaccg

SEQ ID NO: 373163 - DNA, 738 bp, Homo sapiens
  misc_feature: GZ8MTXP01AJ3AP.15.87.H10.1.454.CMB.2.raw
  modified_base (350)..(350): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgcttattttagaaggtgtccagtgtgaggtgcagttggtggagtcgtgggggagcttggtccaaccgtgggggtccctgagactctcctgtgcagcctcgtggattcattctttaataggtttttgatgaccgtgggtccgccgagggtccgaggggaggggctgggagtgggtggaccaaanataaagacgaaagagtaggaaagtaggaaacgtaaaatacgtaagtggtaggaaacttcgtggtagggaaacgggggccctatttaccaaccgtattccctaccaagaacgaacccgaaaccgtacccgaaaagtaaacctttacgtaggttactcgttagaacctaaaagttacggaaaccgaggtaccccgtagggaaagggaccgggaccggaaggtacccgaacggggtccttcgttagttacctttaacgtggtacggttccgggtaaacggttccttaaccccgttcccgttcgggttccggggttaccccggggtaacccgttaccgggttttccccgtaacggggccttaacggttcggggttaacccggttcccggggg

SEQ ID NO: 373164 - DNA, 697 bp, Homo sapiens
  misc_feature: GZ8MTXP01DN9SE.15.87.H10.1.454.CMB.2.raw
  modified_base (606)..(606): a, c, t, g, unknown or other
tcagtctacgtagccacgaccggtgctcgatttagcagtactgcgttgggtttggggggtctcagagaggagccttagccctggactccaaggcctttccacttggtgatcagcactgagcacagaggactcaccatggaattgggactgagcttgggttttccttgttgcttattttagaaggtgtccagtgtgaggtgctaggttggtggagtcgtgggggagcgttggtccaaccgtgggggtccctgagactctcctgtgcagcctcgtggtattctattactttaatggttttgattcgaccgtcgggtccgccgagggtccgaggggaggggcgtgggaggtggggtcggaccaaagaataaaggcaaaggagtagggaaagtaggaaacgtaaatactagtggtacggtaaccttagtggtagggaaccggggtaccgtacttcccacctacgttacccaccgaaggaaccgaaaccgaaaccgacccgtaaaagttaaaccctttacgtagtaacttacagaaactaaagtagaaacgtacggtccgtagggaaagggacgggacggacggtacgacggtcttacgtagtacttacgngtcgacggtacgaccttcccgtcgttcgggttcggccgggtaaccgttaccggttccgtacggcgttacggtcgggttaacccggtcgggg

SEQ ID NO: 373165 - DNA, 629 bp, Homo sapiens
  misc_feature: GZ8MTXP01BGHI6.15.87.H10.1.454.CMB.2.raw
  modified_base (240)..(240): a, c, t, g, unknown or other
  modified_base (283)..(283): a, c, t, g, unknown or other
  modified_base (301)..(301): a, c, t, g, unknown or other
  modified_base (346)..(346): a, c, t, g, unknown or other
  modified_base (388)..(388): a, c, t, g, unknown or other
  modified_base (497)..(497): a, c, t, g, unknown or other
  modified_base (546)..(546): a, c, t, g, unknown or other
tcagtctacgtagccacgaccggtgctcgatttagcagtactgcgttgggttttccttgttgctattttagaaggtgtccagtgtgaggtgcagttggtggagtcgtggggggaggcttggtccaaccgtggggggtccctgagactctcctgtgcagcctctggattcattcttttaatagtttttggatgacctgggtccgccagggtccaggggaagggctggagtgggtgaccaanataaagcaagataggaagtgaagaaatactatgtggactgtgngaagggccattcacatcncagagacaacgaccaaagtacttactgtatctagacaaatgaacncgccgtggaggaggcgaggaccacggcttagtgttattacgngtgcgagtacttaccctctcggtcggggaccggtccgttacggtttccgacggctaggtcgggacggtacggtccgggggaccaacggggcccacgtccacccgttccncgtacacgccctaccgaaccgaccggcctacgtccggtcccttccccgngcccctccctcctacgacgccgccgtaccgtcgggcggggccacggccggcccgtccggtggcttaccggcgttcggtaaccg

SEQ ID NO: 373166 - DNA, 675 bp, Homo sapiens
  misc_feature: GZ8MTXP01AXWMN.15.87.H10.1.454.CMB.2.raw
  modified_base (245)..(245): a, c, t, g, unknown or other
  modified_base (253)..(253): a, c, t, g, unknown or other
  modified_base (313)..(313): a, c, t, g, unknown or other
  modified_base (318)..(318): a, c, t, g, unknown or other
  modified_base (356)..(356): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgaccgtgggtccgccaggggtccaggggaaggggctggaggtgggtggaccaaanaataaagnaaaggataggaagtgaagaaatactagtggtggactcgtgtggaacgggccatcacatcncaganacaacgccaaagtaacttctgtatctgacaaatgaacngctaggagagggcgaaggtaccaaccggtctcttaggtattactggtagcggaagtactacccgttccgtgcggggaccggtccgtacggtttaccgtacggaccgtaggtcgggacgttcggtacgggggaccgaaacgggtacccgaccggtaccgaccgtccctcccggtacgacccgtcctaccccgaacgtaaacccgggccctacgtcccgttccccgttccccgtcggacccctccccgtctacccgaacgcgaccgaccgtcgcggggccacgaacggccgccgtggccgttacgtccgttaaggtaaccg

SEQ ID NO: 373167 - DNA, 606 bp, Homo sapiens
  misc_feature: GZ8MTXP01C6SSZ.15.87.H10.1.454.CMB.2.raw
  modified_base (300)..(300): a, c, t, g, unknown or other
  modified_base (305)..(305): a, c, t, g, unknown or other
  modified_base (321)..(321): a, c, t, g, unknown or other
  modified_base (329)..(329): a, c, t, g, unknown or other
  modified_base (343)..(343): a, c, t, g, unknown or other
  modified_base (361)..(361): a, c, t, g, unknown or other
  modified_base (371)..(371): a, c, t, g, unknown or other
  modified_base (410)..(410): a, c, t, g, unknown or other
  modified_base (533)..(533): a, c, t, g, unknown or other
tcagtctacgtagccacgaccggtgctcgatttagcagtactgcgttgggtttttccttgttgctattttagaaggtgtccagtgtgaggtgcagttggtggagtcgtggggggaggcttggtccaaccgtggggggtccctgagactctcctgtgcagcctctggattcattcttttaatagtttttggatgacctgggtccgccgagggtccaggggaagggctggagtgggtgaccaaacataaagcaaagatggaagtgaagaaatactatgtgactctgtgaaggcatcacatcncaganacaacgcaaagactangtatctanacaaatgaacagcngagaggcgagacacgctntgtattacgngtgcgagactaccctcgcgcggcggctacgttccacggnagtggacgtggtcggggaccaacgggacctacggtcacccgtctcgtcgacgccctaccgaaccgaacggccctacgttcccgtcccttccccgcgcccacccctcccgtaacgaacggaccnccgtacccgtcggttaccggggcttaccggcgggcccggtccggttcggggacttccggccgttcggtaaccg

SEQ ID NO: 373168 - DNA, 871 bp, Homo sapiens
  misc_feature: GZ8MTXP01A8U7G.15.87.H10.1.454.CMB.2.raw
  modified_base (200)..(200): a, c, t, g, unknown or other
  modified_base (297)..(297): a, c, t, g, unknown or other
  modified_base (328)..(328): a, c, t, g, unknown or other
  modified_base (344)..(344): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccnccgagggtccagggagggctggagtgggtgccaacataaagcaagatggaagtgaagtaaatactagtgtagactcgtgtaggaacgggctatcacntcacagacacaacgacaatacctatgtactnagaataaatcgaaacncgtacctagggaacggacggacggtaacgggacctaacccgggtcttacgtagttaacttacggtgggttcggaacggtaaacggtaaccttcccgttcggcgttacgggggccggttacccgttacggtttacccggaacgtccgtaggtaccggggtacgttaccggggacggggaaacccgaaaccgggggtaccctaacccggggttaccctaacccgggtttcccctaacccgggttcccggaaacccggtttccccccctaaaccgggtaaaccccggaaacccccgggggtccccctttaccggggtcccccggggttttaacccccctttcccccccgggaaacgggttcccccccctaacccccgttaaccccccgggtaaagttaacccggaaaccccgttccccgtaaaccccgggtttcggggaccccgggggttaccttaccccgggaacgggcccccgggtcccggtaacgggtcccggttccggtaaccccggttaaggttaaacccccggg

SEQ ID NO: 373169 - DNA, 639 bp, Homo sapiens
  misc_feature: GZ8MTXP01CVLUU.15.87.H10.1.454.CMB.2.raw
  modified_base (234)..(234): a, c, t, g, unknown or other
  modified_base (277)..(277): a, c, t, g, unknown or other
  modified_base (342)..(342): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaagggctggagtgggtgccaanataaagcaaagatggaagtgaagaaatactatgtggactctgngaagggccattcaccatctccagagacaaacgccaaagaactttactgtatctgacaaatgaacngcctggagaggcgaggacacggctctgtattactgtgcgaggacttacccctcctcgtggggccgggcccgtacgggtttcccgtacgggccagtcgggtacgtcggtcgggggaccgaaacggggaccgaccgggtccgacccgttcctcccggttcacgtccctcccgaaccgaaccgggcccacgttcccgggttcccttcccccgtcgggccctcccctccctacccgaaacgaccgccgacccgtcgttcgggggccacgcggccggccgtgggcttcgtccgttggtaacg

SEQ ID NO: 373170 - DNA, 691 bp, Homo sapiens
  misc_feature: GZ8MTXP01DNZ5C.15.87.H10.1.454.CMB.2.raw
  modified_base (623)..(623): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaattagtttttggatgaccgtgggtccgccgaggggtccaggggaaggggctgggaggtggggtcgccaaacaataaagcaaagagtagggaaagtgaagtaaaatactaagtggtggacttcgtaggtaggaaacggggccgtaattacccaaccaacttcctacccaaggaacgaacaaaccgaccaaaagtaactttactgtaactctagaacaaaagtcgaaacacgacctggaacggagggacgaaggaccaccggtctcgttagtacttacgtggtcgcggaagtaccttaccgtccgtcggtacgggccgggtccgtacggtttccgacggtcaggtacggtaccggtacggtacggggaccgtaacgggaccgaccggtcctaccgtcctccgtcacgccctaccgaccgacggcccacgtcccgtcctcccgcgcccnccctcctccaagtcgcctaccgtcggacgggccacgcgccggccgtggcttcgtccgttcggtaaccg

SEQ ID NO: 373171 - DNA, 665 bp, Homo sapiens
  misc_feature: GZ8MTXP01E3K81.15.87.H10.1.454.CMB.2.raw
  modified_base (202)..(202): a, c, t, g, unknown or other
  modified_base (241)..(241): a, c, t, g, unknown or other
  modified_base (282)..(282): a, c, t, g, unknown or other
  modified_base (304)..(304): a, c, t, g, unknown or other
  modified_base (309)..(309): a, c, t, g, unknown or other
  modified_base (328)..(328): a, c, t, g, unknown or other
  modified_base (377)..(377): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgacctgggtccncaggggtccaggggaagggctggagtgggtggaccaaanataaaagcaagataggaagtgaagaaatactatgtggactntgtagaacgggcattcacatcncaganacaacgccaaagacttacngttatctagacaaatgaaacagcctaggagaggacgaggacaccggctntgtattacgtgcgcgagacttaccctcgtagtcggggaccggtccgtacggtttaccgtacggactaggtcggacggtcggtacgggaccgaacgggaccgacggtacctaccgtctcccgtcaccgtccctacccgaaccgaaccgggcccctaacgttcccggttcccgttcccccgtcggacccctaccccgtaaccctaccgaaacgaccgccgtaacccgtcggttcgggggccaccgaaccggccggtccccgtgggccgttacgtcccgttcggtaacccg

SEQ ID NO: 373172 - DNA, 857 bp, Homo sapiens
  misc_feature: GZ8MTXP01CQA6A.15.87.H10.1.454.CMB.2.raw
  modified_base (318)..(318): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgaccgtgggtccgccgaggggtccgaggggaaggggctgggaggtggggtcggaccaaacataaagcaaagagtggaagtgaagaaatactatgtgactcgtgtggaagggcattcacatctccaganacaacgaccaaagtaacttctagatctagaacaaaagtcgaaactacggccgtaggaaggacggacggaacggaccgtacccggtcctacgttgttaacttacgtgtacggaacggtaaggtaccttacccgttcccgtcggtcgggggtacccgggtacccgttacggggttttcccgaaccgggtactaagggttcgggtaaacccggtttcggggtaccggggggaacccgaaaccgggggtaacccgtaacccgggttacctaaaccccggtttcccgtaccccggttcggaaacccggtacccccgttaccccggaaaccccggtaaaccgggggtaccccctaagttcccccggggttaccccgttcccccccggtcggtaccccctacccccgttaacccctaacccgaaaacgggttacccgccccgtaaaccccggttcgggttaccggggggcccaaaccgggaacccggggtccccgggtccccggtcggggcccgttcgggtaacccgggttcgggtaaaaccccgg

SEQ ID NO: 373173 - DNA, 809 bp, Homo sapiens
  misc_feature: GZ8MTXP01DSFYO.15.87.H10.1.454.CMB.2.raw
  modified_base (231)..(231): a, c, t, g, unknown or other
  modified_base (239)..(239): a, c, t, g, unknown or other
  modified_base (269)..(269): a, c, t, g, unknown or other
  modified_base (279)..(279): a, c, t, g, unknown or other
  modified_base (282)..(282): a, c, t, g, unknown or other
  modified_base (297)..(297): a, c, t, g, unknown or other
  modified_base (342)..(342): a, c, t, g, unknown or other
  modified_base (401)..(401): a, c, t, g, unknown or other
tcagtctacgtagccacgaccggtgctcgatttagcagtactgcgttgggttttccttgttgctattttagaaggtgtccagtgtgaggtgcaggttggtggagtcgtggggggaggcttgggtccaaccgtgggggggtccctgagactctcctgtgcagcctctggattcattctttaatagtttttggatgacctgggtccgcagggtcagggaagggctggagtggngaccaaanaataaagcaaagataggaagtgaagaaatntatgtgactntgngaaggcatcacatcncagagacaacgctaaagtaacttactgtactctagaacaaaagtnaaacgagaccgagacggaaggccgaaaggactaaccggccttataggttaaatcgtggngaaccggtaaggtaaacttacccgtcccctgggtcgggggaccgggtacccttaaacgggtttcccgtaacggccgaagttcgggaaccggttccggtacgggggaacccggaaacggggtaccgaacccggttaccgaaccccggttcccttcccggtacccaaacgggtcccccctacccgaaaaccccgggaaacccggggtacccccgtaaaccggttccccggggtttaccccccttccccccgttccggggtacccccaaccccccgttaaccccgtaacccaaaacgggcctttaccccgaaacccgtttcccgggttaccggggggaccaaacccgggcggccccggggtttcccgcggggggaccttccgggtaaccccgtttaaggggtaaaccccgg

SEQ ID NO: 373174 - DNA, 698 bp, Homo sapiens
  misc_feature: GZ8MTXP01C3H3E.15.87.H10.1.454.CMB.2.raw
  modified_base (203)..(203): a, c, t, g, unknown or other
  modified_base (357)..(357): a, c, t, g, unknown or other
  modified_base (497)..(497): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagcttgggttttccttgtgctattttagaagtgtccagtgtgagtgcagttggnggagtcgtgggggaggcttggtccaaccgtgggggtccctgagactctcctgtgcagccctctggattcattactttaagtagtttttggattcgaccgtgggtccgcccgaggggtcccaaggggaacggggctgggagtgggtagaccaaanataaagcaaagagtaggaagtagaagtaaatacttagtggtagaaccgttcgtggtagggaaacgggccgaactttaccacctaagtcctacccgagaacgacaacggtaccaaagtaaacttactagtactaccgttanaactaagtacgaaacgacgtaccggtagaacgggacggaacggaacggtaccgaccggtcttacggttagttaccgtttacggtggtacggaccggtaacgttacccgttaccccgttcgttccggttcgggggttcccgggtaacccgtttacgggttccccgttaacggggcgttacggtaacggggttccggttcggg

SEQ ID NO: 373175 - DNA, 597 bp, Homo sapiens
  misc_feature: GZ8MTXP01CI6OR.15.87.H10.1.454.CMB.2.raw
  modified_base (236)..(236): a, c, t, g, unknown or other
  modified_base (278)..(278): a, c, t, g, unknown or other
  modified_base (292)..(292): a, c, t, g, unknown or other
  modified_base (374)..(374): a, c, t, g, unknown or other
  modified_base (393)..(393): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattcttttaattagtttttggatgacctgggtccgccagggtccagggaagggctggagtgggtgccaanaataaagcaagatggaagtgaagaaatactatgtgactctgngaggcatcacatcncagagacaaacgccaaagaacttactgtatctgacaaaatcgaaacagcctggagaggcgaggacacggtctactgtatacngtgcgagaactcctctcgnggcggcctaggttctacggcagtcggacgtcgtacggggaccgaacggaccgacggtacaccgtcctcctccaacgcccacccgaaccgaacgggccctacgtcccggtcccttccccctacgcccaaccccttccaccaacgacgccaaccgtcgttacgggggcacgcggccggccgtcgggcgcggtcccgttggtaaccg

SEQ ID NO: 373176 - DNA, 567 bp, Homo sapiens
  misc_feature: GZ8MTXP02JR28P.15.87.H10.1.454.CMB.2.raw
  modified_base (321)..(321): a, c, t, g, unknown or other
  modified_base (373)..(373): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccgattcaccatctccagagacaacgccaaagaacttacngtatctgcaaaatgaacagcctgagaggcgaggacaccggctctgtattacngtgcgaggatacctcctctggcgggccaggttcctacggcatggacgtcgtggggccaagggaccacggtcaccgtctcctcagcctccaccaacgggcccactccggtccttccccctcggccacccctcctcccaagacgccaccgtcgtcgggggcacgaacgccggcccgtcgggctcgccgtaggtccg

SEQ ID NO: 373177 - DNA, 553 bp, Homo sapiens
  misc_feature: GZ8MTXP02GWC7A.15.87.H10.1.454.CMB.2.raw
tcagtctacgtagccacgaccggtgctcgatttagcagtactgcgttgggtttccttgttgctattttagaaggtgtccagtgtgaggtgcagttggtggagtctggggaggcttggtccaacctgggggtccctgagactctcctgtgcagcctctggattcatctttaatagttttggatgacctgggtccgccagggtccagggaagggctggagtgggtggccaacataaagcaagatggaagtgagaaatactatgtggactctgtgaagggccattcaccatctccagagacaacgccaaagaacttactgtatctgcaaaatgaaacagcctgagaggcgaggacaccggctctgtattactgtgcgaggatacctcctctggcgggccagttcctacggcatggacgtctggggccaagggaccacggtcaccgtctcctcagcctccaccaacgggcccatcggtcttccccctggcacccctcctccaacgacgcacctcgtcgggggcacaagccggccctcggggcctcgccctggtaccg

SEQ ID NO: 373178 - DNA, 577 bp, Homo sapiens
  misc_feature: GZ8MTXP02FXUQL.15.87.H10.1.454.CMB.2.raw
  modified_base (322)..(322): a, c, t, g, unknown or other
  modified_base (393)..(393): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccattcaccatctccagagacaacgccaaagaactttacngtatctgcaaaatgaacagcctgagaggcgaggacaccggctctgtattactgtgcgaggactacctcctntgggcgggtccacgtttcctacggcagtggacgtcgtggggccgaagggaccacggtcaccgtctcctcacgccctccaccaacgggcccagtccggtccttccccctggccacccctcctccaacgacgccaccgtcgtcgggggcacgaacgccggcccgtcgggcctcggccctggtaccg

SEQ ID NO: 373179 - DNA, 580 bp, Homo sapiens
  misc_feature: GZ8MTXP02JUPPQ.15.87.H10.1.454.CMB.2.raw
  modified_base (320)..(320): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagttttggatgacctgggtccgccagggtccagggaagggctggagtgggtggccaacataaagcaagatggaaagtgagaaatactatgtggactctgtgaaggccgattcaccatctccagagacaacgccaaagaacttacngtatctgacaaaatgaacagcctgagaggcgaggacaccggctctgtattactgtgcgagatacctcctctgggcggccaggttcctacggcagtggacgtcgtggggccgaagggaccgacggtcaccgtctcctcacgcctccaccgacgggcccactccggtccttcccccgtcggcccaccctccctccaacgacgccacccgtcgtcgggggcaccgaacggcccggcccgtcggggcctcggcccgtggtaccg

SEQ ID NO: 373180 - DNA, 564 bp, Homo sapiens
  misc_feature: GZ8MTXP02GFVKU.15.87.H10.1.454.CMB.2.raw
  modified_base (294)..(294): a, c, t, g, unknown or other
tcagtctacgtagccacgaccggtgctcgatttagcagtactgcgttgggtttccttgttgctattttagaaggtgtccagtgtgaggtgcagttggtggagtctgggggaggcttggtccaacctggggggtccctgagactctcctgtgcagcctctggattcatctttaatagttttggatgacctgggtccgccagggtccagggaaggggctggagtgggtggccaaacataaagcaaagatggaagtgagaaatactatgtggactctgtgaaggccgatcaccatcnccagagacaacgccaaagaacttactgtatctgcaaaatgaaacagcctgagaggcgaggacacggctctgtattactgtgcgaggatacctcctctggcggccagttcctacggcatggacgtcgtggggccaagggaccacggtcaccgtctcctcagcctccaccaacggcccatccggtccttccccctcggccaccctccctacccaaagacgccacctcgtcgggggccacgaacgccggcccgtcggggctcgcctcggtacg

SEQ ID NO: 373181 - DNA, 577 bp, Homo sapiens
  misc_feature: GZ8MTXP02JUMAQ.15.87.H10.1.454.CMB.2.raw
tcagtctacgtagccacgaccggtgctcgatttagcagtactgcgttgggtttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccgattcaccatctccagagacaacgccaaagaacttactgtatctgcaaaatgaacagcctgagaggcgaggacacggctctgtattactgtgcgaggataccctctctgggccgggccacggtttcctacggcatggacgtcgtcgggggccgaaggggaccacggtcaccgtctcctcacgcctccaccaacgggcccacgtccggtccttcccccgtggccacccctccctcccaagacgccacctcgtcgggggcacgaacggcggcccgtcgggcctcgcccgtggtaccg

SEQ ID NO: 373182 - DNA, 603 bp, Homo sapiens
  misc_feature: GZ8MTXP02JIBB6.15.87.H10.1.454.CMB.2.raw
  modified_base (319)..(319): a, c, t, g, unknown or other
  modified_base (373)..(373): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaaggccatcaccatctccagagacaacgccaaagaactttacngtatctgcaaaatgaaacagcctgagaggcgaaggacacgggctctgtattacngtgcgaggactacctcctcgtgggccgggccacggtttcctacggcatggacgtcgtcggggccgaacgggaccgacggtcaccgtctcctcgacgccctaccaccgaaacggcccaacgtccgggttcccttcccccgtcggccctacccctccctacccaaacggacgaccaccgtccgtcgggggccacgaacggccggcccgtcgggcctcggcccgtcggtaccg

SEQ ID NO: 373183 - DNA, 604 bp, Homo sapiens
  misc_feature: GZ8MTXP02FWD6Y.15.87.H10.1.454.CMB.2.raw
  modified_base (378)..(378): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccagggtccagggagggctggagtgggtggccaacataaagcaaagatggaagtgagaaaatactatgtggactctgtgaaggccgattcaccatctccagagacaaacgccaaagaacttactgtatctgacaaaatgaaacagcctgagaggcgaggacaccggctctagtattacngtgcgagactacctcctcgtggccgggctaggtttcctacggcagtggacgtcgtcgggggaccgaaacgggaccgaacggtcacccggtctcctcacgccctaccaaccgaaaccgggcccacgtccggtccttcccccgtcggccaacccctccctaccaaacgcgaccaccgtccgtcgggggcacgaacggccggcccgtcggggctcgccgtcggtaaccg

SEQ ID NO: 373184 - DNA, 557 bp, Homo sapiens
  misc_feature: GZ8MTXP02H5R7U.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccaggggtccaggggaagggctgggagtggggtggccaacataaagcaagatggaagtgagaaatactatgtggactctgtgaagggccgattcaccatctccagagacaacgcaagaacttactgtatctgcaaatgaacagcctgagaggcgaggacacggctctgtattactgtgcgaggatacctcctctgggcgccaggtttccacggcatggacgtcgtggggccaagggaccacggtcaccgtctcctcagcctccaccaagggcccatccggtcttccccctggccaccctcctaccagacgccacctcgcgggggcacgaagcggccctgggttcgccgtcggtcaacgg

SEQ ID NO: 373185 - DNA, 576 bp, Homo sapiens
  misc_feature: GZ8MTXP02H77GR.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagttttggatgacctgggtccgccagggtccagggaagggctgggagtggggtggccaacataaagcaagatggaagtgagaaatactatgtggactctgtgaagggccgattcaccatctccagagacaacgccaaagaacttactgtatctgcaaaatgaacagcctgagaggcgaggacaccggctctgtattactgtgcgagataccctcctctggcgggccacggttccacggcagtggacgtcgtggggccgaagggaccacgtcaccgtctcctcacgccctccaccaacgggcccagtccggtccttcccccgtcggccacccctccctaccaaacgacgaccacctcgtcgggggccacgaacggccggcccgtgggcctcgcctcggtacg

SEQ ID NO: 373186 - DNA, 554 bp, Homo sapiens
  misc_feature: GZ8MTXP02JCF7C.15.87.H10.1.454.CMB.2.raw
  modified_base (317)..(317): a, c, t, g, unknown or other
  modified_base (370)..(370): a, c, t, g, unknown or other
  modified_base (388)..(388): a, c, t, g, unknown or other
tcagtctacgtagccacgaccggtgctcgatttagcagtactgcgttgggtttccttgttgctattttagaaggtgtccagtgtgaggtgcagttggtggagtctggggaggcttggtccaacctggggggtccctgagactctcctgtgcagcctctggattcatctttaatagttttggatgacctgggtccgccagggtccagggaagggctggagtgggtggccaacataaagcaagatggaagtgagaaatactatgtggactctgtgaagggccattcaccatctccagagacaacgccaaagaacttacngtatctgcaaaatgaaacagcctgagaggcgaggacaccggctctgtattacngtgcgaggataccctctntggcgggccaggttcctacggcatggacgtctggggccaagggaccacggtcaccgtctcctcagcctccaccaacggcccatccggtcttccccctgccaccctcctccaacacgccacctcgcgggggcacgaacgcggtcccgcgggctcgccgtcggtaccg

SEQ ID NO: 373187 - DNA, 562 bp, Homo sapiens
  misc_feature: GZ8MTXP02IRRTT.15.87.H10.1.454.CMB.2.raw
  modified_base (321)..(321): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttacngtatctgcaaaatgaacagcctgagaggcgaggacaccggctctgtattactgtgcgaggatacctcctctggcgggccaggtttcctacggcatggacgtcgtcgggggccaaggggaccacggtcaccggtctcctcacgcctccaccaacgggcccatcggtcttccccctcggccaccctcctccaagacgcacctcgtcgggggcacgaagccggccgtcgggctcgccgtgtacg

SEQ ID NO: 373188 - DNA, 552 bp, Homo sapiens
  misc_feature: GZ8MTXP02GFNDA.15.87.H10.1.454.CMB.2.raw
  modified_base (262)..(262): a, c, t, g, unknown or other
  modified_base (268)..(268): a, c, t, g, unknown or other
  modified_base (452)..(452): a, c, t, g, unknown or other
  modified_base (493)..(493): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtctgggggaggcttggtccaaccgtggggggtccctgagactctcctgtgcgngcctcnggatcatcttaatagttttggatgacctggtcgccgaggtccagggagggctggagtggtggccaacataaagcaagagtggaagtgagaaatactaatgtggactctgtgaagggccgtattcaccatctccagacgaacaacgtcccaaagtaaacttctgtaatctgacaaatggaaaccngcagagacggacgaggactacgctgtagtattacgtgacgngacgtacgtactcgtcgtcggcggtcgtacgttacgtacgacgacgtacggtacgtcgg

SEQ ID NO: 373189 - DNA, 607 bp, Homo sapiens
  misc_feature: GZ8MTXP02FTJVQ.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaaagatggaaagtgagaaaatactatgtggactctgtgaagggccattcaccatctccagagacaacgccaagaacttactgtatctgcaaatgaacagcctgagaggcgaggacaccggctctgtattactgtgcgaggactacctcctcgtgggccgggcctacggtttcctacggcagtggacgtcgtcggggccgaaacgggaccgacggtcacccgtcctcctcacgccctccgaaccgaacgggcccacgtcccggttccttcccccgtcggccctacccctccctacccaaacgacgccaccgtccgtcgggggccaccgaacggccggcccgtcggggcctcggccgtacggtaccg

SEQ ID NO: 373190 - DNA, 539 bp, Homo sapiens
  misc_feature: GZ8MTXP02FS3S8.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaacctggggggtccctgagactctcctgtgcagcctctggattcatctttaatagttttggatgacctggtccgccagggtccagggaggggctggagtgggtgccaacataaagcaaagatggaaagtgaagaaatactatgtggactctgtgaagggccgattcacatctccagagacaacgccaaagactactgtatctagcaaatgaaacagcctagaggaggcgaggacacggctctgtattactgtgcggaggataccctcctcgtggccgggcctagggtttcccacggcagtcgggactcgg

SEQ ID NO: 373191 - DNA, 560 bp, Homo sapiens
  misc_feature: GZ8MTXP02I0QBQ.15.87.H10.1.454.CMB.2.raw
  modified_base (322)..(322): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggtccctgagactctcctgtgcagcctctggattcatctttaatagtttttggatgacctgggtccgccagggtccagggaaggggctggagtgggtggccaacataaagcaagatggaaagtgagaaaatactatgtggactctgtgaaggccgattcaccatctccagagacaacgccaaagaacttacngtatctgcaaatgaacagcctgagaggcgaggacacggctctgtattactgtgcgagatacctcctcgtggcgggccaggttctacggcatggacgtcgtggggccgaagggaccacggtcaccgtctcctcacgcctccaccaacgggcccactcggtccttccccctggccaccctcctccaaagacgcacctcgtcgggggcacgaacgccggcctcggggctcgcctcggtacg

SEQ ID NO: 373192 - DNA, 575 bp, Homo sapiens
  misc_feature: GZ8MTXP02GAXWN.15.87.H10.1.454.CMB.2.raw
  modified_base (372)..(372): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccgattcaccatctccagagacaacgccaaagaacttactgtatctgcaaaatgaacagcctgagaggcgaggacacggctctgtattacngttgcgaggatacctcctctggccgggccaggtttcctacggcatggacgtcgtggggccgaagggaccacggtcaccgtctcctcagcctccaccaacgggcccatccggtccttcccccgtcggccacccctccctcccaaacgacgccacctccgtcgggggccacgaacgccggcccgtcgggctcggcctcggtaccg

SEQ ID NO: 373193 - DNA, 585 bp, Homo sapiens
  misc_feature: GZ8MTXP02JKPWL.15.87.H10.1.454.CMB.2.raw
  modified_base (273)..(273): a, c, t, g, unknown or other
  modified_base (292)..(292): a, c, t, g, unknown or other
  modified_base (317)..(317): a, c, t, g, unknown or other
  modified_base (370)..(370): a, c, t, g, unknown or other
tcagtctacgtagccacgaccggtgctcgatttagcagtactgcgttgggtttccttgttgctattttagaaggtgtccagtgtgaggtgcagttggtggagtctggggaggcttggtccaacctggggggtccctgagactctcctgtgcagcctctggattcattctttaatagtttttggatgacctgggtccgccagggtccagggaagggctggagtgggtggccaaacataaagcaagatggaagtgaagaaatactatgtggactntgtgaaggccatcacatcncagagacaacgccaaagaacttacngtatctgacaaatgaacagcctagagaggcgaggacaccggctctgtattacngtgcgagactacccgtcctcgtgggccggtaccgtacggttccgtacggcagtcggacgtcgtcggggaccgaacgggaccacggtccaccgtcctcctcacgccctaccaaccgaacgggcccacgtccggtccttcccccgtcggtcccaccctccaccaacgacgccaccgtcgcggggcacgcgccggccgtcggctcgccgtcggtaccg

SEQ ID NO: 373194 - DNA, 552 bp, Homo sapiens
  misc_feature: GZ8MTXP02GCIVA.15.87.H10.1.454.CMB.2.raw
  modified_base (318)..(318): a, c, t, g, unknown or other
tcagtctacgtagccacgaccggtgctcgatttagcagtactgcgttgggtttccttgttgctattttagaaggtgtccagtgtgaggtgcagttggtggagtctgggggaggcttggtccaacctggggggtccctgagactctcctgtgcagcctctggattcatctttaatagttttggatgacctgggtccgccagggtccagggaagggctggagtgggtggccaacataaagcaagatggaagtgagaaatactatgtggactctgtgaagggccgattcaccatctccagagacaacgccaagaacttacngtatctgcaaaatgaacagcctgagaggcgaggacaccggctctgtattactgtgcgaggatacctcctctggcgggccaggtttcctacggcatggacgtcgtggggccaagggaccacggtcaccgtctcctcagcctccaccaacggcccatcggtcttccccctggccaccctcctccaagacgcacctctcgggggcacgaacgcggccctcgggctcgcctggtaccg

SEQ ID NO: 373195 - DNA, 549 bp, Homo sapiens
  misc_feature: GZ8MTXP02HLRMO.15.87.H10.1.454.CMB.2.raw
  modified_base (299)..(299): a, c, t, g, unknown or other
  modified_base (370)..(370): a, c, t, g, unknown or other
tcagtctacgtagccacgaccggtgctcgatttagcagtactgcgttgggttttccttgttgctattttagaaggtgtccagtgtgaggtgcagttggtggagtctggggaggcttggtccaacctggggggtccctgagactctcctgtgcagcctctggattcatctttaatagttttggatgacctgggtccgccagggtccagggaagggctggagtgggtggccaacataaagcaagatggaagtgagaaatactatgtggactctgtgaagggccgattcaccatctccaganacaacgccaaagaacttactgtatctgcaaaatgaacagcctgagaggcgaggacacggctctgtattacngtgcgagatacctcctctggcggccagtttcctacggcatggacgtcgtggggccaagggaccacggtcaccgtctcctcagcctccaccacggccatcggtctccccctgccaccctcctccaacgacgcacctcgtcgggggcacgaacgcggcccgtcgggctcgccgtggtaccg

SEQ ID NO: 373196 - DNA, 582 bp, Homo sapiens
  misc_feature: GZ8MTXP02JP6QC.15.87.H10.1.454.CMB.2.raw
  modified_base (376)..(376): a, c, t, g, unknown or other
  modified_base (395)..(395): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaaagaactttactgtatctgcaaaatgaaacagcctgagaggcgaggacaccggctctgtattacngtgcgaggataccctcctntgggcgggccaggtttcctacggcagtggacgtcgtgggggccaagggaccacggtcaccgtctcctcacgcctccaccgaacgggcccacgtccggtccttccccctcggccaccctccctccaacgacgccacctccgcgggggcaccgaacggccggcccgtcgggcctcggccgtcggtaccg

SEQ ID NO: 373197 - DNA, 587 bp, Homo sapiens
  misc_feature: GZ8MTXP02HFOTA.15.87.H10.1.454.CMB.2.raw
  modified_base (363)..(363): a, c, t, g, unknown or other
  modified_base (372)..(372): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccaggggaagggctggagtgggtggccaacataaagcaaagatggaagtgagaaatactatgtggactctgtgaagggccattcaccatctccagagacaacgccaaagacttactgtatctgacaaaatgaacagcctgagagcgaggacacggctntgtattacngtgcgagactacctcctcgtgggccgggcctagtttcctacggcagtggacgtcgtgggggccgaacggggaccacggtcaccgtcctcctcacgccctccacccgaacgggcccacgtccggtccttcccccgtcggcccacccctcctacccaagacgccaccgtcgcgggggccacgaacggccggcccgtcgggctcggccgtaggtaccg

SEQ ID NO: 373198 - DNA, 590 bp, Homo sapiens
  misc_feature: GZ8MTXP02JU554.15.87.H10.1.454.CMB.2.raw
  modified_base (339)..(339): a, c, t, g, unknown or other
  modified_base (364)..(364): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgaagaaatactatgtggactctgtgaaggccattcaccatctccagagacaacgccaaagaacttactgtatctgacaaaatgaacngcctgagaggcgaggacaccggctntgtattactgtgcgaggactaccctctgtcgggccgggccgtacggttccgtacggcagtcggacgtcgtggggaccgaacgggaccgacggtccaccgtcctcctcgacgccctccaccgaacgggcccacgtccggtccttcccccgtcgcccaccctccctccacgacgccaccgtccgcggggcacgaacgccggcccgtcgggcgtcgccgtacggtaccg

SEQ ID NO: 373199 - DNA, 600 bp, Homo sapiens
  misc_feature: GZ8MTXP02GQDQV.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagttttggatgacctgggtccgccagggtccagggaagggctggagtgggtggccaacataaagcaaagatggaagtgagaaatactatgtggactctgtgaagggccgattcaccatctccagagacaacgccaaagaacttactgtatctgacaaaatgaacagcctgagaggcgaggacaccggctctgtattactgtgcgaggactacctcctcgtgggccgggccgtacggtttccgtacggcagtggacgtcgtcgggggccgaacgggaccgacggtccaccggtcctcctcacgccctccacccgaacgggcccacgtccggtccttcccccgtcggcccacccctccctacccaacgacgccaccgtccgtcgggggccacgaacggccggcccgtcgggcctcgccgtcggtacg

SEQ ID NO: 373200 - DNA, 704 bp, Homo sapiens
  misc_feature: GZ8MTXP02H2MNV.15.87.H10.1.454.CMB.2.raw
  modified_base (343)..(343): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctgggagtggggtggccaacataaagcaagatggaagtgaagaaatactatgtggactctgtgaagggacattcaccatctccagagacaacgccaaagaacttactgtatctgacaaaatgaaacngcctgagaggcgaggacaccggctctgtattactggtgcgaggtatacccctccgtctcggggcgggtacccgtacggttccgtacggctacgtgggaccggttcgtcgggggaccgaacggggacccgacgggtccgacccggtcctccgtcacgccctacccgaacccgaaacggggcccccaacgttcccgggttcccctttaccccccgtcgggtccccaacccccttccccgtacccgtaaaccggaaccgacccgtaaccccgtacccggtccggggggacccaaccggaaccgggccccggggtcccccggtacgggggtcccttccgggtccccgtttcggggtaaaccccgg

SEQ ID NO: 373201 - DNA, 589 bp, Homo sapiens
  misc_feature: GZ8MTXP02F3JTK.15.87.H10.1.454.CMB.2.raw
  modified_base (323)..(323): a, c, t, g, unknown or other
  modified_base (375)..(375): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaaacataaagcaaagatggaagtgagaaatactatgtggactctgtgaagggccattcaccatctccagagacaacgccaaagaacttacngtatctgcaaaatgaacagcctgagaggcgaggacaccggctctgtattacngtgcgaggactacctcctcgtgggccgggccgtacggtttccgtacggcagtggacgtcgtggggccgaagggaccacggtcaccgtctcctcacgcctccaccgaacgggcccacgtccggtccttcccccgtcggccacccctcctacccaacgactccaccgtcgtcgggggccacgaacgccggcccgtcgggcctcgccgtcggtaccg

SEQ ID NO: 373202 - DNA, 583 bp, Homo sapiens
  misc_feature: GZ8MTXP02ITZ0K.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaaacataaagcaagatggaagtgagaaatactatgtggactctgtgaagggccattcaccatctccagagacaacgccaaagaacttactgtaatctgacaaaatgaaacagcctgagagcgaaggacacggctctgtattactgtgcgagactaccctcctctgggcggtcccgaggtttcctacggcagtggacgtcgtcggggccgaagggaccacggtcaccgtctcctcacgcctccaccaacggcccactccggtccttcccccgtcggcccacccctccctaccaaacgacgaccacctcgcgggggccacgaacggccggcccgtcgggctcgccgtcggtacg

SEQ ID NO: 373203 - DNA, 769 bp, Homo sapiens
  misc_feature: GZ8MTXP02F2JUN.15.87.H10.1.454.CMB.2.raw
  modified_base (295)..(295): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgaagaaatactatgtggactctgtgaaggccattcaccatcnccagagacaacgccaaagaacttactgtatctgacaaaatgaaacacgcgaggaggacggacgaacggacgccgtctagtagttaacttcgtggtacgacgggtaagtaacccttccgtcccgtcggggtccggggacccggtaccggtttaccggttacccggaccgtacgtacgggtacgggtaccggttcgggggacccggggaaaccgggaaacccggtacccggtaccggtaacccgttcccggttaccctcccgtaccgacccgtacccccgtaaacccggaaacccgggtacccccgaccgttaccgggtttccccgtttccccccgttcccggcccgtacccccttacccccttcccgaaacccggaaacgcccgtacccgttacccgggtcgggggacccgggaccaaccgggccgggtccccggtacgggtccggtccgtccgtaccggttacggtaaaaccgg

SEQ ID NO: 373204 - DNA, 564 bp, Homo sapiens
  misc_feature: GZ8MTXP02H0B3Q.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagttttggatgacctgggtccgccagggtccagggaagggctggagtgggtgccaacataaagcaaagatggaagtgaagaaatactatgtggactctgtgaagggccgattcaccatctccagagacaacgccaaagaacttactgtatctgacaaaatgaaacagcctgagaggcgaggacaccggctctgtattactgtgcgaggatacctcctctgggcggccagttcctacggcatggacgtcgtggggcaagggaccacggtcaccgtctcctcacgcctccaccaagggcccacgtcggtccttcccccgtcggccacccctcctaccaacgacgccaccgtcgtcgggggcacgaacgcgcccgtcggctcgcctcggacg

SEQ ID NO: 373205 - DNA, 586 bp, Homo sapiens
  misc_feature: GZ8MTXP02H08ZZ.15.87.H10.1.454.CMB.2.raw
  modified_base (302)..(302): a, c, t, g, unknown or other
  modified_base (307)..(307): a, c, t, g, unknown or other
  modified_base (331)..(331): a, c, t, g, unknown or other
  modified_base (346)..(346): a, c, t, g, unknown or other
  modified_base (379)..(379): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcatctttaatagtttttggatgacctgggtccgccagggtccagggaaggggctgggagtgggtggccaacataaagcaaagatggaagtgaagaaatactatgtggactctgtaggaagggccgattcaccatcncaganacaacgccaaagaacttactgtanctagacaaatgaacngcctagagagcgaggacacggctctgtattacngtgcgagactaccctcctgtcgggcgggtcctacggttcctacggcagtcggacgtcgtcggggaccgaacggggaccgacggtccaccgtcctcctcacgccctccaccgacggcccacgtccgtccttccccgtcgccaccctacctccaacgacgccacctcgtacggggcacgaacggccgccgtcggctcgccgtcggtacg

SEQ ID NO: 373206 - DNA, 578 bp, Homo sapiens
  misc_feature: GZ8MTXP02HPNG1.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccgattcaccatctccagagacaacgccaaagaacttactgtatctgcaaaatgaaacagcctgagaggcgaggacaccggctctgtattactgtgcgaggatacctcctcgtgggcggccgagtttcctacggcatggacgtcgtggggccaagggaccacggtcaccgtctcctcacgcctccaccaacgggcccagtccggtccttcccccgcggccacccctccctccgaaacgacgaccaccttccgcgggggccacgaacggccggcccgtcgggctcgccgtcggtaccg

SEQ ID NO: 373207 - DNA, 591 bp, Homo sapiens
  misc_feature: GZ8MTXP02JDXK4.15.87.H10.1.454.CMB.2.raw
  modified_base (373)..(373): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccgattcaccatctccagagacaacgccaaagaacttactgtatctgcaaaatgaacagcctgagaggcgaggacaccggctctgtattacngtgcgaggatacctcctcgtggcgggccacggtttcctacggcagtggacgtcgtcggggccgaaacgggacccgacggtccaccggtctcctcacgccctccaccgaacgggcccacgtccggtcccttcccccgtcggccacccctcctccgaacgacgccacctcgtcgggggccacgaacggccggcccgtcggggcctcggccgtcggtaccg

SEQ ID NO: 373208 - DNA, 541 bp, Homo sapiens
  misc_feature: GZ8MTXP02F5NQX.15.87.H10.1.454.CMB.2.raw
  modified_base (475)..(475): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtctgggggaggcttggtccaaccgtggggggtccctgagactctcctgtgcagcctctggattcatctttaatagttttggatgactggtccgcagggtccagggaggggctggagtgggtggccaacataaagcaaagatggaagtgagaaatactatgtggactctgtgaagggcattcacatctcagagacaaacgccaaagaacttactgtaatctgacaaatgaacagcctgagaggcgaggacacgggctctgtattacnggtgcgaggatacctcctcgtggaccggggctacgggtttccctacgggctagtcgggacgttcgg

SEQ ID NO: 373209 - DNA, 599 bp, Homo sapiens
  misc_feature: GZ8MTXP02G9NY5.15.87.H10.1.454.CMB.2.raw
  modified_base (368)..(368): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagttttggatgacctgggtccgccagggtccagggaagggctggagtgggtggccaacataaagcaagatggaagtgagaaatactatgtggactctgtgaaggccgattcaccatctccagagacaacgccaagaacttactgtatctgacaaatgaacagcctgagagcgaggacacggctctgtattacngtgcgaggactacctcctcgtgggccggtcccgtacggtttccgtacggcagtcggacgtcgtcgggggccgaacgggaccacggtcaccgtctcctcacgccctccaccgaacggcccacgtccggtccttcccccgtcggccctacccctccctacccgaacgacgaccacccgtccgtcgggggccaccgaacggccggcccgtcggggcctcggccgtacggtaccg

SEQ ID NO: 373210 - DNA, 568 bp, Homo sapiens
  misc_feature: GZ8MTXP02FWHH7.15.87.H10.1.454.CMB.2.raw
  modified_base (319)..(319): a, c, t, g, unknown or other
  modified_base (372)..(372): a, c, t, g, unknown or other
tcagtctacgtagccacgaccggtgctcgatttagcagtactgcgttgggtttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccattcaccatctccagagacaacgccaaagaacttacngtatctgcaaaatgaaacagcctgagaggcgaaggacacggctctgtattacngtgcgagactacctcctcgtgggccgggcctaggtttcctacggcagtggacgtcgtggggccaacgggaccacggtcaccgtctcctcacgcctaccacgaacggcccatccggtccttcccctcggccaccctcctccaagacgccactcgtcgggggcacgaacgccggcccgtcgggctcgccgtcggtacg

SEQ ID NO: 373211 - DNA, 578 bp, Homo sapiens
  misc_feature: GZ8MTXP02F5HL1.15.87.H10.1.454.CMB.2.raw
  modified_base (374)..(374): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccattcaccatctccagagacaacgccaaagaacttactgtatctgcaaaatgaaacagcctggagaggcgaggacaccggctctgtattacngtgcgaggatacctcctctgggcgggccaggtttcctacggcagtggacgtcgtcggggccgaagggaccgacggtcaccgtctcctcacgccctccaccgaacgggcccacgtccggtccttcccccgtcggccaccctcctccaacgacgcacctcgtcgggggccacgaacgccggcccgtcgggcctcgccgtcggtacg

SEQ ID NO: 373212 - DNA, 599 bp, Homo sapiens
  misc_feature: GZ8MTXP02JWQYJ.15.87.H10.1.454.CMB.2.raw
  modified_base (372)..(372): a, c, t, g, unknown or other
  modified_base (466)..(466): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaaacataaagcaagatggaagtgagaaatactatgtggactctgtgaaggccattcaccatctccagagacaacgccaaagaacttactgtatctgacaaaatgaacagcctgagaggcgaggacaccggctctgtattcngtgcgaggactacctcctcgtgggcgggccgtaggtttccctacggcagtggacgtcgtcggggaccaagggaccacggtcaccggtctcctcncgccctccaaccgaacgggcccacgtccggtccttcccccgtcggcccaccccgtcctacccgaaacgacgccaccgtccgtcgggggaccaccgaacggccggcccgtcggggcctcggccgtcggtaaccg

SEQ ID NO: 373213 - DNA, 653 bp, Homo sapiens
  misc_feature: GZ8MTXP02HSFNV.15.87.H10.1.454.CMB.2.raw
  modified_base (394)..(394): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtgccaaacataaagcaaagatggaaagtgaagaaatactatgtggactctgtgaagggccattcaccatctccagagacaaacgccaaagaacttactgtatctgacaaaatgaaacagcctgagaggcgaggacacggctctgtattactgtgcgagatacctcctntggcggtccacgtttcctacggcagtggacgttcgtcgggggaccgaaacggggacccgacggtccaaccggtcctcccgttcaacgcccctacccaaccccgaacggggaccccctaagttcccgggtccctttccccccgtcgggccctaaaccccctcccttacccgaaacggaccaccgtaacccgtccgtcgggggaccaaccgaacggcccggaccccgttcggggaccttcggaccccgtttgggtaacccg

SEQ ID NO: 373214 - DNA, 560 bp, Homo sapiens
  misc_feature: GZ8MTXP02JW8QE.15.87.H10.1.454.CMB.2.raw
  modified_base (404)..(404): a, c, t, g, unknown or other
  modified_base (430)..(430): a, c, t, g, unknown or other
  modified_base (434)..(434): a, c, t, g, unknown or other
  modified_base (515)..(515): a, c, t, g, unknown or other
tcagtctacgtagccacgaccggtgctcgatttagcagtactgcgttgggtttgggggtcgtcagagaggagccttagccctggactccaaggcctttccacttggtgatcagcactgagcacagaggactcaccatggaattgggactgagctgggtttctgttgctatttagaaggtgtccagtgtgaggtgcagttggtggagtcgtgggggaggcttggtccaaccgtggggggtccctgagactctcctgtgcagcctctggattcatcttaatagttttggatgacctggtccgcagggtccagggaggggctggagtgggtggccaagataaagcaaggatggaaagtgaagaaatacgtatgtggaactctggtgaaaggggccagttcaccatcnccagagacaacgccaaagaacttacngtanctagacaaatgaaacagcctagagggaggacgaggaccgacgggtctacgtagtacttacgtggtgcgaggtactacctcnccgtgggccggcctacggtttaccgacggcagtcggacgttcggg

SEQ ID NO: 373215 - DNA, 626 bp, Homo sapiens
  misc_feature: GZ8MTXP02JZT9N.15.87.H10.1.454.CMB.2.raw
  modified_base (370)..(370): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaaggccgatcaccatctccagagacaacgccaaagaacttactgtatctgcaaaatgaacagcctgagaggcgaggacacggctctgtattacngtgcgaggactacctctcgtgggccgggcctagggtttcccacggcagtggacgtcgtgggggccaaagggccacggtcaccggtctccctcacgcccctaccaaccgaaccgggccctacgtccggttcccttcccccgtggcccctaccccttccctacccgaaaggaccgacccgacccgttccgggcgggggacccaacggccggcccgggtcccgtcgggggtccctcgggtacccgttcggtaaacccgg

SEQ ID NO: 373216 - DNA, 594 bp, Homo sapiens
  misc_feature: GZ8MTXP02GQX9O.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaaacataaagcaaagatggaagtgagaaatactatgtggactctgtgaaggccgattcaccatctccagagacaacgccaaagaacttactgtatctgacaaaatgaacagcctgagaggcgaggacaccggctctgtattactgtgcgaggataccctctctgggcggccgacgtttcctacggcagtggacgtcgtcggggccgaagggaccgacggccaccgtcctcctcacgcctacccaccgaaacgggcccacgtccggtccttcccccgtcggcccacccctccctacccaacgacgccgacctccgtcgggggccaccgaacggccggcccgtcgggccgtcgccgtcggtaccg

SEQ ID NO: 373217 - DNA, 590 bp, Homo sapiens
  misc_feature: GZ8MTXP02FLCE2.15.87.H10.1.454.CMB.2.raw
  modified_base (375)..(375): a, c, t, g, unknown or other
tcagtctacgtagccacgaccggtgctcgatttagcagtactgcgttgggttttccgttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgaagaaatactatgtggactctgtgaaggccgatcaccatctccagagacaacgccaaagaacttactgtatctgacaaaatgaaacagcctgagaggcgaggacacggctctagtattacngtgcgagactacctcctcgtgggccgggcctacggtttcctacggctagtggacgtcgtcggggccgaaacgggaccacggtcaccggtcctcctcacgccctaccaccgaacgggacccgacgtcggtccttccccgtcgccacccctacctaccaacgacgccaacctcgtcgggggcaccgaacgccgcccgtcggcctcgccgtcggtacg

SEQ ID NO: 373218 - DNA, 581 bp, Homo sapiens
  misc_feature: GZ8MTXP02HDJ6E.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctgggagtgggtggccaaacataaagcaaagatggaagtgagaaatactatgtggactctgtgaaggccgattcaccatctccagagacaacgccaaagaacttactgtatctgacaaaatgaaacagcctgagaggcgaggacaccggctctagtattactgtgcgaggactaccgtcctcgtgggccgggccgtacggtttccgtacggcagtggacgtcgtcggggccgaagggaccgacgtccaccgtctcctcacgccctaccaccacgggcccacgtccggtccttccccctcggccacccctccaccaacgacgcacctcgcggggcacgaacgcggccgtcggctcgccgtcgtacg

SEQ ID NO: 373219 - DNA, 594 bp, Homo sapiens
  misc_feature: GZ8MTXP02JOSH1.15.87.H10.1.454.CMB.2.raw
  modified_base (296)..(296): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctgggagtgggtggccaacataaagcaagatggaagtgagaaatactatgtggactctgtgaagggccattcaccatcncagagacaacgccaaagaacttactgtatctgacaaaatgaaacagcctgagaggcgaggacaccggctctgtattactgtgcgaggactaccctcctcgtgggccgggcccgtaggtttcccgtacggcagtggacgtcgtcgggggccaacgggaccgacggtcaccgtcctcctcacgcctccaccgaacgggcccacgtccggtccttcccccgtcggcccaccctccctccaaacgacgccaccgtcgtcgggggccacgaacgccggcccgtcgggctcggccgtcggtacg

SEQ ID NO: 373220 - DNA, 599 bp, Homo sapiens
  misc_feature: GZ8MTXP02JFB93.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccattcacatctcagagacaacgccaaagaacttactgtatctgacaaatgaacagcctgagaggcgaggacaccggctctagtattactgtgcgaggactacccgtcctcgtcgggccgggtccgtacggtttccgtacggcagtggacgtcgtcggggaccgaacgggaccgacggtcgaccgtcctcctcacgccctccaaccgaacggcccacgtccgtcccttcccccgtcggcccaccccgtccctaccaacgaccgccacccgtcgtcggggcacgaacggccggcccgtcgggctcggccgtcggtaccg

SEQ ID NO: 373221 - DNA, 573 bp, Homo sapiens
  misc_feature: GZ8MTXP02J24J5.15.87.H10.1.454.CMB.2.raw
  modified_base (371)..(371): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaaacataaaagcaaagatggaagtgagaaatctatgtggactctgtgaaggccattcaccatctccagagacaacgccaaagactttactgtatctgcaaaatgaacagcctgagaggcgaggcaccggctctgtattcngtgcgagattaccctctctggcgggccctacggtttcctacggcagtggacgtcgtcggggcaacggggaccacggtcaccgtctcctcacgcctccaccaacgggcccagtcgtcccttccccctcggccacccctcctccaacgacgccaccttcgcggggccacgaacgcggcccgtcggggcctcggcctcggtaccg

SEQ ID NO: 373222 - DNA, 606 bp, Homo sapiens
  misc_feature: GZ8MTXP02F7Q8J.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaaggccgattcaccatctccagagacaacgccaaagaactttactgtatctgacaaaatgaaacagcctggagaggcgaggacaccggctctgtattactgtgcgaggactaccctccgtcgtgggccgggccgtacgggtttccgtacggcagtggacgtcgtcgggggaccgaaacggggaccgacggtccaccggtcctccgtcacgccctccgaccgacggcccacgtccggtccttcccccgtcggcccacccctcctaccgaacgacgaccaccgtcgtcgggggcaccgaacgccggccgtcgggcctcggccgtggtaccg

SEQ ID NO: 373223 - DNA, 584 bp, Homo sapiens
  misc_feature: GZ8MTXP02HN5WX.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaaagaacttactgtatctgcaaaatgaacagcctgagaggcgaggacaccgggctctgtattactggtgcgaggatacctcctcgtgggccgggccaggtttcctacggcagtggacgtcgtggggccaagggaccacggtcaccgtctcctcacgcctccaccaacgggcccacgtccggtccttcccccgtcggcctacccctccctacccaacgacgccacctccgtacgggggccacgaacgcggcccgtcgggcctcgccgtggtaccg

SEQ ID NO: 373224 - DNA, 654 bp, Homo sapiens
  misc_feature: GZ8MTXP02HNHHI.15.87.H10.1.454.CMB.2.raw
  modified_base (304)..(304): a, c, t, g, unknown or other
  modified_base (376)..(376): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctgggagtgggtggccaacataaagcaaagatggaagtgaagaaatactatgtggactctgtgaaggccgattcaccatctccaganacaacgccaaagaacttactgtatctgcaaaatgaacagcctgagaggcgaggacaccggctctgtattacngtgcgaggtactaccctcctcgtcgggccgggtccctagggtttccctacgggctagtacgggaccgttcgtcgggggaccgaaacgggggacccaccgggtccgaacccggtcctcctcgacgccctacccgaccgaacgggccccaagttcccgggttcccttcccccgtcggaccctaccccgtccctaccgaaacgaccgaccacccgtccgtcgggggaccaccggaacggtcccgggccccgtcggggcctcggtacccgttcgggtaaccg

SEQ ID NO: 373225 - DNA, 578 bp, Homo sapiens
  misc_feature: GZ8MTXP02HCUY4.15.87.H10.1.454.CMB.2.raw
  modified_base (379)..(379): a, c, t, g, unknown or other
  modified_base (385)..(385): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccagggtccagggaagggctggagtgggtggccaaacataaagcaaagatggaagtgaagaaatactatgtggactctgtgaaggccgattcaccatctccagagacaacgccaaagaacttactgtatctgacaaaatgaaacagcctgagaggcgaggacaccggctctgtatactgngcgagntacctctctggcggctagttctacgcagtggacgtcgtggggaccaagggaccacggtcaccgtctcctcacgccctaccaaccgaacgggcccacgtccggtccttcccccgtcggcccaccccgtcctacccaagcgaccacctcgcgggggccaacgcggccggcccgtcggggctcggccgtggtaccg

SEQ ID NO: 373226 - DNA, 573 bp, Homo sapiens
  misc_feature: GZ8MTXP02I80XB.15.87.H10.1.454.CMB.2.raw
  modified_base (323)..(323): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaaagatggaagtgagaaatactatgtggactctgtgaagggccgattcaccatctccagagacaacgccaaagaacttacngtatctgacaaaatgaacagcctgagaggcgaggacacggctctgtattactgtgcgaggatacctcctctgggcggccaggtttcctacggcagtggacgtcgtcggggccgaagggaccacggtcaccgtcctcctcacgccctccaccacggcccacgtccggtcctcccccgtgcccaccctcctccaacgacgcacctcgtcgggggcacgaacgccggcccgtcgggcctcgccgtcggtaccg

SEQ ID NO: 373227 - DNA, 584 bp, Homo sapiens
  misc_feature: GZ8MTXP02IUYNO.15.87.H10.1.454.CMB.2.raw
  modified_base (236)..(236): a, c, t, g, unknown or other
  modified_base (296)..(296): a, c, t, g, unknown or other
  modified_base (301)..(301): a, c, t, g, unknown or other
  modified_base (320)..(320): a, c, t, g, unknown or other
  modified_base (374)..(374): a, c, t, g, unknown or other
  modified_base (390)..(390): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattcttttaatagtttttggatgacctgggtccgcagggtccagggaagggctggagtgggtgccaanataaagcaagatggaagtgaagaaatactatgtggactctgtgaaggccgatcaccatcncaganacaacgcaaagaacttacngtatctgacaaaatgaaacagcctagagaggcgaggacacggctctgtattacngtgcgagactacctcngtgggcggtccgtacgtttccacggcagtggacgtcgtcggggaccaagggaccacggtcaccgtcctcctcacgccctaccaccgaacgggcccacgtccgtcccttcccccgtcgcccacccctcctaccaacgacgaccaccgtcgtcggggcacgaacggccggcccgtcgggcctcgccgtggtaaccg

SEQ ID NO: 373228 - DNA, 615 bp, Homo sapiens
  misc_feature: GZ8MTXP02G5Z5N.15.87.H10.1.454.CMB.2.raw
  modified_base (322)..(322): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccaggggaagggctggagtgggtggccaacataaagcaagatggaagtgagaaatactatgtggactctgtgaagggccattcaccatctccagagacaacgccaaagaactttacngtatctgacaaatgaacagcctgagaggcgaggacaccggctctagtattactgtcgcgagactaccctcctcgtgggccgggtccgtacggttccgtacggcgacgtggacgtcgtcggggaccgaacggggaccgaccggtccgacccggtcctccctcgaccgccctaccgaccgaaccggccctacgtcccgtcccgttcccccgtcgcccaccctaccctaccgaacgaccgccacccgtcgtacgggggccacgcggccggccgtcggccgtcggccgtacggaccg

SEQ ID NO: 373229 - DNA, 576 bp, Homo sapiens
  misc_feature: GZ8MTXP02FVIGH.15.87.H10.1.454.CMB.2.raw
  modified_base (198)..(198): a, c, t, g, unknown or other
  modified_base (232)..(232): a, c, t, g, unknown or other
  modified_base (316)..(316): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccnccagggtccagggagggctggagtggtggccaanataaagcaagatggaagtgagaaatctatgtggactctgtgaaggccattcaccatctccagagacaacgccaaagaacttacngtatctgacaaaatgaaacagcctagagaggcgaaggacaacggctctagtattacgtgtgcgaggactacctcctcgtgggcgggcctaggtttccacggcaatggacgtcgcggggaccaacggggaccacggtccaaccggtcctcctcacgccctaccaaccgaacggcccatccggtccttcccccgtgccaccctcctaccaacgcgcacctcgtacggggcacgaacggccgccgtggcctcgacctggtacg

SEQ ID NO: 373230 - DNA, 577 bp, Homo sapiens
  misc_feature: GZ8MTXP02JS3JU.15.87.H10.1.454.CMB.2.raw
  modified_base (294)..(294): a, c, t, g, unknown or other
  modified_base (319)..(319): a, c, t, g, unknown or other
  modified_base (371)..(371): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaaggccattcaccatcnccagagacaacgccaaagacttacngtatctgcaaaatgaacagcctgagaggcgaggacaccggctctgtattacngtgcgaggactacctcctgtgggccgggccacgtttcctacggcagtggacgtcgtcggggccgaagggaccgacggtcacccgtctcctcacgcctcccaccaaacgggcccacgtccggtccttcccccgtcggccacccctcctccaacgacgccacctcgcgggggcaccgaacgccggcctcgggctcgccgtcggtaccg

SEQ ID NO: 373231 - DNA, 592 bp, Homo sapiens
  misc_feature: GZ8MTXP02FPX9I.15.87.H10.1.454.CMB.2.raw
  modified_base (460)..(460): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaagaacttactgtatctgacaaaatgaacagcctgagaggcgaggacaccggctctgtattactgtgcgaggactacctcctctgggcgggcctaggtttcctacggcagtggacgtcgtcggggaccgaagggaccacggtcaccgtcncctcacgccctccaccaacgggcccacgtccggtcctcccccgtcggcccacccctccctaccaacgacgccaacccgtccgtcgggggccaacgaacggccggccccgtcggggcctcgccgtcggtaccg

SEQ ID NO: 373232 - DNA, 597 bp, Homo sapiens
  misc_feature: GZ8MTXP02JOKUB.15.87.H10.1.454.CMB.2.raw
  modified_base (370)..(370): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaaggccgattcacatctccagagacaacgccaaagaacttactgtatctgcaaaatgaacagcctgagaggcgaggacacggctctgtattacngtgcgaggatacctcctcgtgggccgggccctaggtttccctacggcagtggacgtcgtcggggccgaacgggaccgacggtcgaccgtccgtcctcgacgccctcccaccgaacgggcccacgtccggtccttcccccgtcggcccacccctccctaccaacgacgccacccgtccgtcgggggccacgaacggccggcccgtcgggccgtcggccgtcggtaccg

SEQ ID NO: 373233 - DNA, 582 bp, Homo sapiens
  misc_feature: GZ8MTXP02INBXY.15.87.H10.1.454.CMB.2.raw
  modified_base (297)..(297): a, c, t, g, unknown or other
  modified_base (323)..(323): a, c, t, g, unknown or other
  modified_base (376)..(376): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaaacataaagcaagatggaagtgagaaaatactatgtggactctgtgaagggccgattcaccatcnccagagacaacgccaaagaacttacngtatctgacaaaatgaaacagcctgagagcgaaggacacggctctgtattacngtgcgaggactacctcctcgtggcgggcctacggtttcctacggcagtggacgtcgtcggggacaacgggaccacggtcaccgtctcctcagccctccaccaacgggcccatccggtccttccccctcggccaccccttccaccaaacgacgaccaccctccgtcgggggccacgaacgccggcccgtcggcctcgcctcggtacg

SEQ ID NO: 373234 - DNA, 600 bp, Homo sapiens
  misc_feature: GZ8MTXP02IV4N3.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatctttaatagtttttggatgacctgggtccgccagggtccagggagggctggagtgggtgccaacataaagcaagatggaagtgagaaatactatgtggactctgtgaagggccgattcacatctccagagaaaacgccaaagaaacttactgtatctagacaaaatgaaacagcctgagaggcgaggacacggcctctgtattactgtgcgaggactacctcctcgtgggccgggcctaggtttccgtacggcagtggacgtcgtggggccgaagggaccgacggtcaccgtctcctcacgcctaccaccgaacgggcccacgtccggtcccttcccccgtcggccctaccctccctaccaacgacgccaccgtccggtcgggggaccaccgacggccggcccgcgggctcggccgtcggttacgaaacgg

SEQ ID NO: 373235 - DNA, 579 bp, Homo sapiens
  misc_feature: GZ8MTXP02J0M8K.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaaacataaagcaagatggaagtgagaaatactatgtggactctgtgaagggccgattcaccatctccagagacaacgccaaagaacttactgtatctgcaaaatgaacagcctgagaggcgaggacacggctctgtattactgtgcgaggatacctctctgggcgggccaggtttcctacggcatggacgtcgtggggccgaagggaccacggtcaccgtctccctcacgcctccaccaacgggccccaagtccggtccttcccccgtggcccacccctccctaccgaacgacgcacccgtcgtcgggggccacgaacgcggccctcggggcctcgccgtcggtacg

SEQ ID NO: 373236 - DNA, 592 bp, Homo sapiens
  misc_feature: GZ8MTXP02GE4YB.15.87.H10.1.454.CMB.2.raw
  modified_base (322)..(322): a, c, t, g, unknown or other
  modified_base (376)..(376): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaaacataaagcaaagatggaagtgagaaatactatgtggactctgtgaaggccattcaccatctccagagacaacgccaaagaactttacngtatctgacaaaatgaacagcctggagaggcgaaggcaccggctctgtattacngtgcgagatacctctgtgggccgggcctacggttcctacggcagtggacgtcgtcggggaccgaacgggaccgacggtccaccgtcctcctcacgccctcccgaccgaacggcccacgtccggtcccttcccccgtcggcccacccctcctacccgaaacgacgccacccgtcgtcggggcacgaacgccggcccgtcggctcgccgtcggtaccg

SEQ ID NO: 373237 - DNA, 585 bp, Homo sapiens
  misc_feature: GZ8MTXP02JXY2X.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaaggccgattcaccatctccagagacaacgccaaagaacttactgtatctgacaaaatgaacagcctgagaggcgaggacaccggctctgtattactgtgcgaggataccctcctcgtgggcgggccgtacggtttccgtacggcagtggacgtcgtcgggggccgaacgggaccacggtccaccgtctcctcacgcctccaccgaacgggcccacgtccggtcccttcccccgtcggcccaccccgtccctaccaacgacgcaccgtcgcggggcacgaacgccggcccgcggctcgccgtggtaccg

SEQ ID NO: 373238 - DNA, 599 bp, Homo sapiens
  misc_feature: GZ8MTXP02GQ1S0.15.87.H10.1.454.CMB.2.raw
  modified_base (292)..(292): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagttttggatgacctgggtccgccagggtccagggaagggctggagtgggtggccaacataaagcaagatggaagtgagaaatactatgtggactctgtgaaggccgatcaccatcnccagagacaacgccaaagactactgtatctgacaaatgaacagcctgagagcgaggacacggctctgtattactgtgcgagactacctcctcgtgggcgggccgtacgtttccgtacggcagtaggacgtcgtcggggaccgaacgggaccgacggtcaacccgtctaccgtaacgccctcccaaccgaacgggacccacgtccggtcccttcccccgtcggcccacccctccctacccgaacgacgccacccgtcgtcgggggccacgacggccggcccgtcgggcctcgccgtcggtacgaacgg

SEQ ID NO: 373239 - DNA, 610 bp, Homo sapiens
  misc_feature: GZ8MTXP02IFCDU.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctggagactctcctgtgcagcctctggattcattctttaattagttttggatgaccgtgggtccgccgagggtccgaggggaaggggcgtggaggtggggtggaccaaacgaataaagcaaagatagggaagtgaagaaaatactagtgtggacttcgtgtagaaggccgattccacatccaccagagaacaacgccaaagaacttactgtaatctgacaaatgaacagcctagaggagcgaaggacacggtctcgtgtaattacgtggtacgacggaaggtaccttacccgtccgttcggtacgggcccggggaacccgttacggtttccccgtacgggcctacgtcggggaacgttcccggggg

SEQ ID NO: 373240 - DNA, 591 bp, Homo sapiens
  misc_feature: GZ8MTXP02G7D5K.15.87.H10.1.454.CMB.2.raw
  modified_base (515)..(515): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttgaatgacctgggtccgccagggtccagggaagggctgggagtgggtggccaacataaagcaagatggaagtgagaaatactatgtggactctgtgaaggccgattcaccatctccagagacaacgccaagaacttactgtatctgacaaatgaacagcctgagaggcgaggacaccggctctgtattactgtgcgaggatacccgtctcgtcgggccgggccgtacggtttcccgtacggcagtggacgtcgtcggggccgaacgggaccgacggtccgaccgtctcctcacgcctaccaccgacggcccacgtccgtccttccccgtcgccnccctccctaccaacgacgccaccgtccgtcggggacacgaacggccggcccgtcgggccgtcggccgtcggtaccg

SEQ ID NO: 373241 - DNA, 617 bp, Homo sapiens
  misc_feature: GZ8MTXP02GRAR7.15.87.H10.1.454.CMB.2.raw
  modified_base (236)..(236): a, c, t, g, unknown or other
  modified_base (277)..(277): a, c, t, g, unknown or other
  modified_base (296)..(296): a, c, t, g, unknown or other
  modified_base (322)..(322): a, c, t, g, unknown or other
tcagtctacgtagccacgaccggtgctcgatttagcagtactgcgttgggttttccttgttgctattttagaaggtgtccagtgtgaggtgcagttggtggagtcgtgggggaggcttggtccaaccgtggggggtccctgagactctcctgtgcagcctctggattcattctttaatagtttttggatgacctgggtccgccagggtccagggaagggctggagtgggtgccaanataaagcaaagatggaaagtgaagaaatactatgtggactntgtgaaggccatcacatcnccagagacaacgccaaagaacttacngtatctgacaaaatgaacagcctagagagcgaggacaccggctctagtattactgtgcggagactacctcctcgtgggccggccgtacggtttccgtacggctagtcggacgtcgtcggggaccgaaacgggaccgacggtccaacccggtcctcccgtcgacgccctaccgacccgaaacgggccccagttcccggtcccttcccccgtcggtcccacccgtccctaccaacgaccgccacccgtcgtcggggcaccgaacgcccggcccgtcggccgtcgccgtcggtaaccg

SEQ ID NO: 373242 - DNA, 569 bp, Homo sapiens
  misc_feature: GZ8MTXP02HOX3Y.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtgccaacataaagcaaagatggaagtgaagaaatactatgtggactctgtgaagggccgattcaccatctccagagacaaacgccaaagaacttactgtatctgcaaaatgaaacagcctgagaggcgaggacaccggctctgtattactgtgcgaggatacctcctcgtggcgggtcccaggtttcctacggcatggacgtcgtggggccaaggggaccacggtcaccgtctcctcacgcctccaccaacggcccactcggtccttccccctcggccaccctcctccaacgacgccacctcgtcgggggcacgaacgcgcccgtcggctcgccgtggtaccg

SEQ ID NO: 373243 - DNA, 595 bp, Homo sapiens
  misc_feature: GZ8MTXP02GDHPT.15.87.H10.1.454.CMB.2.raw
  modified_base (200)..(200): a, c, t, g, unknown or other
  modified_base (321)..(321): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcattctttaatagtttttggatgacctgggtccnccagggtccagggagggctggagtgggtggccaacataaagcaagatggaagtgaagaaatactatgtggactctgtgaaggccattcaccatctccagagacaacgccaagaactttacngtatctgacaaaatgaacagcctagagagcgaggacaccggctctagtattactgtgcgaggactacctccgtcgtgggccgggcctacggtttcctacggcagtggacgtcgtcggggaccgaacgggaccgacggtcaccgtcctcctcacgccctacccaccgaacgggcccacgtccggtccttcccccgtcggcccacccctcctacccaagacgccaccgtcgtcggggcacgaacggccggcccgtcgggcgtcgccgtcggtaccg

SEQ ID NO: 373244 - DNA, 606 bp, Homo sapiens
  misc_feature: GZ8MTXP02JHNTC.15.87.H10.1.454.CMB.2.raw
  modified_base (373)..(373): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaaggccgattcaccatctccagagacaacgccaaagaacttactgtatctgacaaaatgaaacagcctgagaggcgaggacacggctctgtattacngtgcgaggactacctcctgtgggccgggcctacggtttccctacggcagtcggacgtcgtcgggggccgaaggggacccgacggtcaccggtctacctcacgccctccgaaccgaacgggccccaagtccggtccttcccccgtcggcccaccccgtccctacccgaaacgaccgccacccgtcgtcgggggccaacgcggccggcccgtcggggcctcggccgtggtaaccg

SEQ ID NO: 373245 - DNA, 587 bp, Homo sapiens
  misc_feature: GZ8MTXP02JWFLB.15.87.H10.1.454.CMB.2.raw
  modified_base (321)..(321): a, c, t, g, unknown or other
  modified_base (340)..(340): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctgggagtgggtggccaacataaagcaagatggaaagtgagaaatactatgtggactctgtgaagggccattcaccatctccagagacaacgccaaagacttacngtatctgcaaaatgaaacngcctgagaggcgaggacacggctctgtattactgtgcgaggactaccctctctggggcgggcccgaggtttcctacggcagtggacgtcgtcggggccgaaggggaccacggtcaccgtctcctcacgcctccaccaacgggcccacgtccggtccttccccctcggccacccctccctaccaacgacgccaccgtccgtcgggggccacgaacggccggcccgtcgggcctcgcccgtcggtaccg

SEQ ID NO: 373246 - DNA, 594 bp, Homo sapiens
  misc_feature: GZ8MTXP02GL1N9.15.87.H10.1.454.CMB.2.raw
  modified_base (379)..(379): a, c, t, g, unknown or other
tcagtctacgtagccacgaccggtgctcgatttagcagtactgcgttgggctttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccagggtccagggaagggctggagtgggtggccaacataaagcaaagatggaagtgaagaaatactatgtggactctgtgaagggccgattcaccatctccagagacaacgccaaagaacttactgtatctgacaaaatgaaacagcctggagaggcgaggaccacggctctgtattacngtgcgaggactacctcctctgggccgggccgtacggtttcctacggcagtggacgtcgtggggaccgaacgggaccgacggtcaccgtctccctcacgccctccaccgaacgggcccacgtccggtcccttccccctcggccctaccctccctaccaacgacgccaccgtcgtacgggggccaacgacgccggcccgtcgggcctcgcccgtcgg

SEQ ID NO: 373247 - DNA, 602 bp, Homo sapiens
  misc_feature: GZ8MTXP02INC25.15.87.H10.1.454.CMB.2.raw
  modified_base (232)..(232): a, c, t, g, unknown or other
  modified_base (295)..(295): a, c, t, g, unknown or other
  modified_base (314)..(314): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggagggctggagtgggtgccaanataaagcaagatggaagtgagaaatactatgtggactctgtgaaggccattcacatctcaganacaacgcaaagaacttacngtatctgacaaatgaacagcctagagaggcgaggacaccggctctgtattacgtgtgcgagactaccctccgtcgtcggggccgggtaccgtacggtttcccgtacggtcagtggtacgtcgtcggggaccgaacgggacccgacggtccaccgtcctcctcacgccctaccgaacccgacggcccacgtccgtcccttccccgtcgcccaccctcctaccgaacgacgccaccgtcgtcggggcaccgaacggccggcccgtcggccgtcggtaccgtcggtaaccg

SEQ ID NO: 373248 - DNA, 598 bp, Homo sapiens
  misc_feature: GZ8MTXP02FXHGV.15.87.H10.1.454.CMB.2.raw
  modified_base (340)..(340): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaaggccgattcaccatctccagagacaacgccaaagaacttactgtatctgcaaaatgaaacngcctggagaggcgaggaccacggctctgtattactgtgcgaggatacctcctcgtggcgggcctaggtttcctacggcagtggacgtcgtggggccgaacgggaccgacggtcaccgtctcctcacgccctaccaccgaaccgggcccacgtccggtcccttcccccgtcggcccacccctccctaccaacgacgccaccctccgtcgggggccaaccgaacggccggcccgtcggggccgttcggccgtcggtaccg

SEQ ID NO: 373249 - DNA, 604 bp, Homo sapiens
  misc_feature: GZ8MTXP02G2RZP.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaaagaacttactgtatctgacaaaatgaacagcctgagaggcgaggacaccggctctgtattacgtgtgcgaggactaccctcctcgtgggccgggtccctacggtttccgtacggtcagtcggaccgtcgtcggggccgaacgggaccgacggtccaccgtctcctcacgcctaccgacccgaacggcccacgtccggtcccttcccccgtcggcccacccgtccctacccaacgcgccaccgtccgtcggggaccacgaacggccggccgtcggctcgccgtcggtaccg

SEQ ID NO: 373250 - DNA, 587 bp, Homo sapiens
  misc_feature: GZ8MTXP02H9GFX.15.87.H10.1.454.CMB.2.raw
  modified_base (233)..(233): a, c, t, g, unknown or other
  modified_base (292)..(292): a, c, t, g, unknown or other
  modified_base (321)..(321): a, c, t, g, unknown or other
  modified_base (373)..(373): a, c, t, g, unknown or other
  modified_base (522)..(522): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgcagggtccagggaagggctggagtgggtgccaanataaagcaaagatggaagtgaagaaatactatgtggactctgtgaaggcatcaccatcncagagacaacgacaaagaacttactgtanctagacaaaatgaaacagcctagagaggcgaggacaccggctctgtattacnggtgcgaaggactaccctccgtctcggggccggtcccgtacgtttcccgacggtaccgagtcgggacgtcggtcggggaccgaacgggaccgacgtcgaccgtctcctcacgcctaccaccgacggccactccggtcctcccctcgccnccctcctaccagacacaccgtcgtcggggacacgaacgcggcccgtcggcgtcgccgtacgtacg

SEQ ID NO: 373251 - DNA, 619 bp, Homo sapiens
  misc_feature: GZ8MTXP02FJQ66.15.87.H10.1.454.CMB.2.raw
  modified_base (233)..(233): a, c, t, g, unknown or other
  modified_base (294)..(294): a, c, t, g, unknown or other
  modified_base (351)..(351): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtgccaanataaagcaagatggaagtgagaaatactatgtggactctgtgaagggccgattcaccatcnccagagacaacgccaaagaacttactgtatctgacaaaatgaacagcctggagaggngaggacaccggctctgtattacgtgtgcgaaggacttaccctcctgtcggggccgggtccgtaggtttcctacggcagtggacgtcgtcggggaccgaacgggaccgacggtccacccgtctccctccgacgccctacccgaaccgaaaccgggcccgaacgttcccgggttcccttcccccgtcggtcccacccctccctacccgaacgacgccaccgtcgcgggggccaacgcggccggcccgtcggggcctcgccgtcggtaccg

SEQ ID NO: 373252 - DNA, 611 bp, Homo sapiens
  misc_feature: GZ8MTXP02G826B.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccattcaccatctccagagacaacgccaaagaacttactgtatctgacaaatgaacagcctgagaggcgaggacaccggctctgtattactgtgcgagactacctctcgtgggcggccgtacgtttcctacggcagtcggacgtcgtacggggccgaaacggggaccgaccggtcacccgtcctccgtcacgccctaccgaaccgaacgggcccacgtcccggtcccttcccccgtcggcccaccccttccctacccgaaacgaccgccgtaacccgtcggtacgggggcaacgcggccggcccgtcgggcgtcggccgtcggtaaccg

SEQ ID NO: 373253 - DNA, 670 bp, Homo sapiens
  misc_feature: GZ8MTXP02I6RG8.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtgggggtccctggagactctcctgtgcagcctcgtggattcattctttaattagtttttggatcgaccgtgggtccgccgagggtccgaggggaaggggcgtgggaggtggggtggaccaacgaagtaaagcaaagatagggaagtgaacgaaatactatggtggacttcgtgggtaggaaacggggtccgtactttaccaacctattcccgtacccgaaggaacgaaacccaacggacccaaaaggtaaacctttacgtacggtaattacaggaactaaaatcggaaacacggtcctagggaaggacggacggtaaggaccgacgggcttcgtagtaacgttacgtgtacggacggacggttaaatccccgttctcggtcggggcccggtaaccgttacggtttccgtacgggcctagttcggggaccgttcggg

SEQ ID NO: 373254 - DNA, 567 bp, Homo sapiens
  misc_feature: GZ8MTXP02GKYPK.15.87.H10.1.454.CMB.2.raw
  modified_base (233)..(233): a, c, t, g, unknown or other
  modified_base (292)..(292): a, c, t, g, unknown or other
  modified_base (318)..(318): a, c, t, g, unknown or other
  modified_base (539)..(539): a, c, t, g, unknown or other
tcagtctacgtagccacgaccggtgctcgatttagcagtactgcgttgggtttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaanataaagcaagatggaagtgagaaatctatgtggactctgtgaaggccgattcaccatcnccagagacaacgccaaagaacttacngtatctgcaaaatgaaacagcctgagaggcgaaggacaccggctctgtattactgtgcgaggataccctcctctgggcggccaggtttcccacggcatggacgtcgtggggaccaagggaccacggtcaccgtctcctcagcctccaccaacggcccagtccggtcctcccccgtcggccacccctcctccaaacgacgccacctcgtacgggggcaccgngccggccgtcgggcctcgccgtggaccg

SEQ ID NO: 373255 - DNA, 552 bp, Homo sapiens
  misc_feature: GZ8MTXP02H5YW0.15.87.H10.1.454.CMB.2.raw
  modified_base (237)..(237): a, c, t, g, unknown or other
  modified_base (505)..(505): a, c, t, g, unknown or other
  modified_base (519)..(519): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatctttaatagtttttggatgacctgggtccgccaggggtccagggaagggctggagtgggtggccaaanataaaagcaaagatggaaagtgaagaaaatactaatgtggactctgtgaagggccgattcaccatctccagagacaacgccaaagaacttaactgtaatctgacaaaatgaaacagcctgagaggcgaggacaccggctctgtattactgtgcgaggatactcctctgggcgggccacgtttccacggcatggacgtctggggcaaagggaccacggtcaccgctcctcagcctcaccaaggcccatcggcttcccctggcaccctcncccagacgcactcngggggcacaagcggcctcgggctcgcctggacg

SEQ ID NO: 373256 - DNA, 591 bp, Homo sapiens
  misc_feature: GZ8MTXP02GVT38.15.87.H10.1.454.CMB.2.raw
  modified_base (322)..(322): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaaacataaagcaagatggaagtgagaaatactatgtggactctgtgaagggccgattcaccatctccagagacaacgccaagaacttacngtatctgacaaaatgaacagcctgagaggcgaggacacggctctgtattactgtgcgaggtactaccctcctcgtgggccgggtccgtaggtttccgtacggcagtggacgtcgtcgggggaccaacgggaccacggtccaccgtcctcctcacgcctaccacccgaacggcccactccggtccttcccccgtcggcccacccctcctaccaacgcgaccaccgtcggcggggcacgaacggccggcccgtcggcctcgccgtcgtacg

SEQ ID NO: 373257 - DNA, 595 bp, Homo sapiens
  misc_feature: GZ8MTXP02JMMUQ.15.87.H10.1.454.CMB.2.raw
  modified_base (326)..(326): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccaggggaaggggctggagtggggtggccaaacataaagcaagatggaagtgaagaaatactatgtggactctgtgaagggccattcaccatctccagagacaacgccaaagaactttacngtatctgacaaaatgaaacagcctgagaggcgaggacaccggctctgtattactgtgcgagactaccctcctcgtgggtcgggccgtacggttccgtacggcagtggacgtcgtcgggggaccgaacgggaccgacggtcgaccgtctcctcacgcctccaaccgaacggccacgtccgtccttcccccgtcggcccaccctccctaccaacgacgccaccgtcgtcggggcacgaacgccggcccgtcgggctcggccgtcggtaccg

SEQ ID NO: 373258 - DNA, 569 bp, Homo sapiens
  misc_feature: GZ8MTXP02I6ZR5.15.87.H10.1.454.CMB.2.raw
  modified_base (321)..(321): a, c, t, g, unknown or other
  modified_base (374)..(374): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccgattcaccatctccagagacaacgccaaagaacttacngtatctgacaaaatgaacagcctgagaggcgaggacaccggctctgtattacngtgcgaggataccctcctgtggcgggccaggttcctacggcatggacgtcgtggggccaagggaccacggtcaccgtcctcctcacgcctccaccaacgggcccagtccggtccttcccccgtcggccacccctcctaccaacgacgccacctcgcggggcacgaacgccggcccgtcgggctcgcctcggtacg

SEQ ID NO: 373259 - DNA, 591 bp, Homo sapiens
  misc_feature: GZ8MTXP02G0NYC.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaagggctggagtgggtggccaacataaagcaagatggaagtgaagaaatactatgtggactctgtgaagggccattcaccatctccagagacaacgccaaagaacttactgtatctgacaaaatgaacagcctgagaggcgaggacacggctctgtattactgtgcgagactacctctctgggcgggcctagttccgtacggcagtggacgtcgtcggggacgaacgggaccgacgtccaccgtctcctcacgcctaccaccgaacgggcccacgtccggtcccttcccccgtcggcccacccctccctaccgaaacgacgaccaccgttccgacgggggccacgaacgccggcccgtcggcgtcgccgtcggtaaccg

SEQ ID NO: 373260 - DNA, 683 bp, Homo sapiens
  misc_feature: GZ8MTXP02JZGE1.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcattctttaattagtttttggatgaccgtgggtccgccgagggtccgaggggaaggggctgggaggtggggtggaccaaacaagtaaagcaaagagtagggaaagtagaagaaaatactagtggtaggacttcgtggtagggaacggggtccgtattaccacctatcctacccgaagacgaaccaaacgacccaaaagtaacctttacgtagttaactctagactaaaatcgaaaccacgacctaggaagggacgggacgaacgggaaccaccgggtcttacgttagttaacttacgtggtacggacggtacggtaaacttccccgtccgtcggttccggggccggggtaaccccgttacggggttttaccccgacgggtacctacgggttccgggtaacgttccggggg

SEQ ID NO: 373261 - DNA, 581 bp, Homo sapiens
  misc_feature: GZ8MTXP02GB9X4.15.87.H10.1.454.CMB.2.raw
  modified_base (298)..(298): a, c, t, g, unknown or other
  modified_base (324)..(324): a, c, t, g, unknown or other
  modified_base (377)..(377): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaaacataaagcaaagatggaagtgagaaaatactatgtggactctgtgaagggccattcaccatcnccagagacaacgccaaagaacttacngtatctgcaaaatgaaacagcctgagaggcgaggacaccggctctgtattacngtgcgagatacctcctgtggcgggcctagttcctacggcatggacgtcgtggggaccgaagggaccacggtcaccgtctcctcacgcctaccaccaaacgggcccatccggtccttccccctcgccacccctcctcccaaacgacgaccacctcgtcgggggccacgaacgccggcccgtcgggttcgccgtcggtacaaacgg

SEQ ID NO: 373262 - DNA, 595 bp, Homo sapiens
  misc_feature: GZ8MTXP02JGBRX.15.87.H10.1.454.CMB.2.raw
  modified_base (197)..(197): a, c, t, g, unknown or other
  modified_base (316)..(316): a, c, t, g, unknown or other
  modified_base (369)..(369): a, c, t, g, unknown or other
tcagtctacgtagccacgaccggtgctcgatttagcagtactgcgttgggttttccttgttgctattttagaaggtgtccagtgtgaggtgcagttggtggagtctggggaggcttggtccaacctggggggtccctgagactctcctgtgcagcctctggattcatctttaatagtttttggatgacctgggtccnccagggtccagggagggctggagtgggtggccaacataaagcaagatggaagtgagaaatactatgtggactctgtgaaggccattcaccatctccagagacaacgccaaagacttacngtatctgacaaatgaacagcctgagaggcgaggacaccggctcgtgtattacngttgcggagactaccgtcctgtagggccgggtcccaggtttcctacggcagtggacgtcgtcggggaccgaacgggaccgacggtcaaccggtcgtcctccgacgccctacccgaccaacggggccccacgtccggtcccttcccccgtcggcccaccctccctaccgacgacgccaccgttccgcggggccacgcgccggcccgtcgggctcgccgtggtaaccg

SEQ ID NO: 373263 - DNA, 601 bp, Homo sapiens
  misc_feature: GZ8MTXP02JX41D.15.87.H10.1.454.CMB.2.raw
  modified_base (318)..(318): a, c, t, g, unknown or other
  modified_base (369)..(369): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgaagaaatactatgtggactctgtgaaggccattcaccatctcagagacaacgcaaagaacttacngtatctgcaaaatgaacagcctgagaggcgaggacaccggctctgtattcngtgcgagactacctctgtcgggccggcctacggtttccgtacggcagtggacgtcgtcggggaccgaacgggaccgacggtccacccggtcctccgtcacgtccctacccaccgaaccggccctacgtccggtcccttcccccgtcggcccacccctcctacccgaacgaccgccaccgtccgtcgggggaccacgaacggccggcccgtcgggcctcggccgtcggtaccg

SEQ ID NO: 373264 - DNA, 561 bp, Homo sapiens
  misc_feature: GZ8MTXP02FX8IF.15.87.H10.1.454.CMB.2.raw
  modified_base (339)..(339): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcatctttaatagttttggatgacctggtccgccagggtccagggagggctggagtgggtggccaanataaagcaaagatggaaagtgaagaaaatacaatggtggacttctggtgaaagggccgattcaaccatctacagagacaacgccaaagtaaactactgtaatctagacaaaatgaaacagcctgaagaggacgaggacacggactcgtagtattacgtgtagcggaaggactaccgtcctcgtgggccggaacctagggtttccacggcagtcggactcggg

SEQ ID NO: 373265 - DNA, 607 bp, Homo sapiens
  misc_feature: GZ8MTXP02FSI42.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgcagggtccagggaagggctggagtgggtggccaacataaagcaagatggaagtgagaaatactatgtggactctgtgaaggccgatcaccatctccagagacaacgccaaagaacttactgtatctgacaaaatgaaacagcctggagagcgaggacacggctctagtattacgtgtgcggagactaccgtccgtcgtgggcgggtccacggtttcctacggcagtggacgtcggtcggggaccaacggggaccacgggtccaacccggtcctcctcacgccctacccaccgaacggcccagtcccggttccctcccccgtcggcccacccctccctaccaaacgcaccaccgtcggtacggggccacgaacggcccggcccgtcgggcctcggcccgtggtaaccg

SEQ ID NO: 373266 - DNA, 592 bp, Homo sapiens
  misc_feature: GZ8MTXP02IMFJS.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggagggctggagtgggtggccaacataaagcaagatggaagtgagaaatactatgtggactctgtgaagggccgattcaccatctccagagacaacgccaaagaacttactgtatctgacaaaatgaacagcctgagaggcgaggacaccggctctagtattactgtgcgagatacctcctcgtgggcgggcctacggttcctacggcagtggacgtcgtcgggggccgaacgggaccgacggtccgaccgtcctcctcacgccctaccgaccgaacgggcccacgtccggtcccttccccgtcggccacccctcctaccaacgcgaccaccgtcgtcgggggccacgaacggcccggccgtcgggctcggccgtcggtaccg

SEQ ID NO: 373267 - DNA, 614 bp, Homo sapiens
  misc_feature: GZ8MTXP02GRZ6T.15.87.H10.1.454.CMB.2.raw
  modified_base (384)..(384): a, c, t, g, unknown or other
tcagtctacgtagccacgaccggtgctcgatttagcagtactgcgttgggttttccttgttgctattttagaaggtgtccagtgtgaggtgcagttgttggagtctgggggaggcttggtccaacctggggggtccctgagactctcctgtgcagcctctggattcatctttaatagtttttggatgacctgggtccgccaggggtccaggggaaggggctgggagtggggtggccaaacataaagcaaagatggaagtgaagaaatactatgtggactctgtgaagggccattcaccatctccagagacaacgccaaagaacttactgtatctgacaaaatgaaacagcctagagaggcgaaggacaccggctctgtattacnggtgcgagactaccctcctcgtgggcgggccgtacggtttcctacggcagtggacgtcgtcgggggaccgaagggaccacggtcacccgtctccgtcacgccctccaccgaacggcccacgtccggtcccttcccccgtcggcccacccctccctacccgaagaccgccacccgtcgtcgggggccaccgaacggcccggcccgtcggggcctcggccgtacggtaaccg

SEQ ID NO: 373268 - DNA, 784 bp, Homo sapiens
  misc_feature: GZ8MTXP02IF1PY.15.87.H10.1.454.CMB.2.raw
  modified_base (233)..(233): a, c, t, g, unknown or other
  modified_base (351)..(351): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcattctttaatagtttttggatgacctgggtccgcagggtccagggagggctggagtgggtgccaanataaagcaagatggaagtgaagaaatactagtgtggactctgtaggaagggcctaattcaccatcctaccgaagacgacaaccgccaaaagtaacttcagtatctgacaaaatgaacngctagagaggcgaggacaccggctctagttattacgtggtgcggaagtacctacccttccgtacgtcggggacccggtacccgtacggtttccgtacggtacgagttacgggaccgtcgggtacgggggaccgaaaccggggacccgtaccgggtacccgtaacccgttcccgtaccctaccgtaccgtccccgttaccccgaaccccgtaaaccgggggtaccccctaaccggttcccgggttacccccgtttaccccccggtcccgggtacccccgtaacccccttaccccgtaacccgtaaaacccggtaccggacccgtaaaccccggttccgggttaccggggggtacccaaccgggaacccgggtacccggggtaccccggtccgggggtacccgttccgggtacccgtttaccggggtaacccggg

SEQ ID NO: 373269 - DNA, 585 bp, Homo sapiens
  misc_feature: GZ8MTXP02IZ5YX.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccattcaccatctccagagacaacgccaaagaacttactgtatctgacaaatgaaacagcctgagaggcgaggacacggctctgtattactgtgcgaggactaccctcctcgtgggcgggcctacggttcctacggcagtggacgtcgtcggggccgaagggaccacggtcaccgtctcctcacgcctccaaccgaacggcccacgtccgtccttcccccgtcgccacccgtcctaccaacgacgaccaccgtcgtcgggggaccacgaacggccggcccgtcggggcctcggccgtcggtacg

SEQ ID NO: 373270 - DNA, 597 bp, Homo sapiens
  misc_feature: GZ8MTXP02GEVG7.15.87.H10.1.454.CMB.2.raw
  modified_base (293)..(293): a, c, t, g, unknown or other
  modified_base (299)..(299): a, c, t, g, unknown or other
  modified_base (318)..(318): a, c, t, g, unknown or other
  modified_base (338)..(338): a, c, t, g, unknown or other
  modified_base (372)..(372): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccatcaccatcnccaganacaacgccaaagacttacngtatctgacaaaatgaaacngcctgagaggcgaggacaccggctctgtattacngtgcgagactaccctcctgtgggccgggtcctacggtttccgtacggcagtcggacgtcgtcggggccgaacgggaccacggtccgaccgtctcctcacgccctccgaccgaacgggcccacgtccggtccttcccccgtcggccctacccctccctaccaacgacgccacctcgtcgggggaccaccgaacggccggcccgtcgggcctcggccgtcggtaccg

SEQ ID NO: 373271 - DNA, 581 bp, Homo sapiens
  misc_feature: GZ8MTXP02FYSQC.15.87.H10.1.454.CMB.2.raw
  modified_base (234)..(234): a, c, t, g, unknown or other
  modified_base (294)..(294): a, c, t, g, unknown or other
  modified_base (321)..(321): a, c, t, g, unknown or other
  modified_base (377)..(377): a, c, t, g, unknown or other
  modified_base (394)..(394): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatcttttaatagtttttggatgacctgggtccgccagggtccagggaagggctggagtgggtgccaanataaagcaagatgggaaagtgaagaaatactatgtgactctgtgaaggccatcaccatcnccagagacaacgccaaagaactttacngtaatctgacaaaatgaaacagcctgagaggcgaggacaccggctctagtattacngtgcgagactacctccncgtggccggctacgttcctacggcatggacgtcgtcggggaccgaacgggaccacggtcaccggtctcctcacgcctccaaccaacggcccacgtccggtccttcccccgtcggcccaccctcctaccaagcgacaccgtcgtacgggggcacgaacgccggccgtcgggcgtcgccgtcggtaccg

SEQ ID NO: 373272 - DNA, 576 bp, Homo sapiens
  misc_feature: GZ8MTXP02FEN12.15.87.H10.1.454.CMB.2.raw
  modified_base (297)..(297): a, c, t, g, unknown or other
  modified_base (322)..(322): a, c, t, g, unknown or other
  modified_base (379)..(379): a, c, t, g, unknown or other
  modified_base (527)..(527): a, c, t, g, unknown or other
  modified_base (568)..(568): a, c, t, g, unknown or other
tcagtctacgtagccacgaccggtgctcgatttagcagtactgcgttgggttctccttgttgctattttagaaggtgtccagtgtgaggtgcagttggtggagtcgtgggggaggcttggtccaaccgtggggggtccctgagactctcctgtgcagcctctggattcattctttaatagtttttggatgacctgggtccgccagggtccagggagggctggagtgggtgccaacataaagcaaagatggaagtgaagaaatactatgtggactctgtgaagggccattcaccatcncagagacaacgccaaagaacttacngtatctgacaaaatgaaacagcctggagaggcgaaggacccacggctctgtattacngtgcgaggactacctctcgtcgggcgggccgtaggttttcccgacgggcagtgggacgtcgtcggggaccgaagggaccacggtccaccgtctccctcacgccctccaccgaaacgggcccatccggtcctcccctggccaccctccnccaaacgcgcacctcgcggggcaacgcgccggcccgtggcncgctacgg

SEQ ID NO: 373273 - DNA, 596 bp, Homo sapiens
  misc_feature: GZ8MTXP02GA503.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaaggccgattcaccatctccagagacaacgccaaagaacttactgtatctgacaaaatgaacagcctggagaggcgaggacacggctctgtattactgtgcgaggactacctcctcgtgggccgggtcctacggtttcctacggcagtggacgtcgtcgggggaccgaacggggaccgacggtcaccgtctcctcacgccctccaccgaacgggcccacgtccggtcccttcccccgtcggccctacccctccctacccaaacgcgaccacccgtcgtacgggggccacgcgccggccgtcgggctcgccgtcggtaccg

SEQ ID NO: 373274 - DNA, 567 bp, Homo sapiens
  misc_feature: GZ8MTXP02F45LW.15.87.H10.1.454.CMB.2.raw
  modified_base (322)..(322): a, c, t, g, unknown or other
  modified_base (375)..(375): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccattcaccatctccagagacaacgccaaagaactttacngtatctgcaaaatgaaacagcctgagaggcgaggacaccggctctgtattacngtgcgaggatacctcctctgggcgggccacggtttcctacggcagtggacgtcgtggggccaaggggaccacggtcaccgtctcctcacgcctccaccaacgggcccatccggtcctccccctggccaccctcctccaagacgccacctcgcgggggcacgaacgcggccctcggggctcggccctggtacg

SEQ ID NO: 373275 - DNA, 590 bp, Homo sapiens
  misc_feature: GZ8MTXP02J10VU.15.87.H10.1.454.CMB.2.raw
  modified_base (418)..(418): a, c, t, g, unknown or other
  modified_base (464)..(464): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcattctttaatagttttggatgacctgggtccgcagggtccgagggaggggctggagtgggtggccaacataaagcaaagatggaagtgaacgaaatactagtgtcggatcgtgtggaagggccgattccactatcctaccaganaccaacgaccaaagtaacttactagtaactctagacaaatgaaacncgcctaggacggagggcgacggtacgacggtctcgtagtacttagtcggtgcgacggtactacccgtccgtacgtcgggtccggtccgtaacgggtttcctacggccgtagtcgggacgttccggg

SEQ ID NO: 373276 - DNA, 585 bp, Homo sapiens
  misc_feature: GZ8MTXP02G57OI.15.87.H10.1.454.CMB.2.raw
  modified_base (322)..(322): a, c, t, g, unknown or other
  modified_base (326)..(326): a, c, t, g, unknown or other
  modified_base (376)..(376): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagttttggatgacctgggtccgccagggtcagggaagggctggagtgggtggccaacataaagcaaagatggaaagtgagaaatactatgtggactctgtgaagggccgattcaccatctccagagacaacgccaaagaacttacngtanctgacaaaatgaaacagcctgagaggcgaggacaccggctctgtattacngtgcgaggatacctcctcgtggcggccacgtttccacggcatggacgtcgtcggggacaacgggaccacggtcaccgtctcctcacgcctccaaccaacgggcccacgtccggtccttcccccgtcggcccacccctccctacccaacgacgccaaccgtcgtcgggggccacgaacgccggcccgtcgggcctcggccgttcggaccg

SEQ ID NO: 373277 - DNA, 591 bp, Homo sapiens
  misc_feature: GZ8MTXP02GQ9IX.15.87.H10.1.454.CMB.2.raw
  modified_base (325)..(325): a, c, t, g, unknown or other
  modified_base (367)..(367): a, c, t, g, unknown or other
  modified_base (378)..(378): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaaacataaagcaagatggaagtgagaaaatactatgtggactctgtgaagggccgattcaccatctccagagacaaacgccaaagaactttacngtatctgcaaaatgaaacagcctgagagcgaggacacggctntgtattactgngcgagatacctcctctggcggccgacgtttccgttacggcagtggacgtcgtcgggaccggaaacgggaaccgacggaccgaccgtcctcctcacgcctcccaccgaaacggaccgactccgtccgttcccccgtccgccgaccctaccctccaaacgaacgacgacctccgtcggggcgacgaacgcggccgtcggcgtcgtccgtcggtcg

SEQ ID NO: 373278 - DNA, 605 bp, Homo sapiens
  misc_feature: GZ8MTXP02G2SS2.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcattctttaatagtttttggatgacctgggtccgccagggtccagggaagggctggagtgggtggccaacataaagcaagatggaagtgaagaaatactatgtggactctgtgaagggccgattcaccatctccagagacaacgccaaagaacttactgtatctgacaaaatgaacagcctgagaggcgaaggacacggctctgtatactgtgcgagactaccctctcgtgggccgggtcccgtacggtttcccgtacggcagtcgggaccgtcggtacgggggaccgaaacggggaccgacggtccacccgtctcctcacgccctaccaaccgacggcccagtcccggtccttccccgtcgccctacccctcctaccgaacgacgccaccgtcgcgggggacacgaacgtccggccgtcggctcggccgtcggtaccg

SEQ ID NO: 373279 - DNA, 600 bp, Homo sapiens
  misc_feature: GZ8MTXP02FUVRS.15.87.H10.1.454.CMB.2.raw
  modified_base (351)..(351): a, c, t, g, unknown or other
  modified_base (374)..(374): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactatcctgtgcagcctctggattcatctttaatagtttttggatgacctgggtccgccagggtccagggaaggggctggagtgggtggccaaacataaagcaagatggaagtgagaaatactatgtggactctgtgaagggccattcaccatctccagagacaacgccaagaacttactgtatctgacaaaatgaacagcctgagaggngaggacaccggctctgtattacngtgcgaggataccctcctcgtgggccgggccgtagtttccgtacggcagtggacgtcgtcggggccgaaggggaccacggtccaccgtcctcctcacgccctcccacccgaacgggcccacgtccggtcccttcccccgtcggcccacccctccctacccaacgacgccaccgtccgtcgggggccaccgaacggccggcccgtcgggcgtcgccgtcggtaaccg

SEQ ID NO: 373280 - DNA, 645 bp, Homo sapiens
  misc_feature: GZ8MTXP02JILGV.15.87.H10.1.454.CMB.2.raw
  modified_base (270)..(270): a, c, t, g, unknown or other
  modified_base (291)..(291): a, c, t, g, unknown or other
  modified_base (297)..(297): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgcagggtccagggagggctggagtgggtgccaacataaagcaagatggaagtgaagaaatactatgtggactntgtgaaggccattcaccatcnccaganacaacgccaaagaacttactgtatctagacaaaatgaaacagcctagagaggcgaaggacacggctctgtattcgtgtcgcgaggacttacctcctacgtggggaccggtccgtacggtttccgtacggtcagtggacgtcgtcggggaccgaacgggaccgacggtcgaccgtcctcctcgtacgccttaccgaccgtaaacggcccgtacgtccggttcccttcccccgtcggcccaccccgttccctacccgaacgtaccgaccgtaaccccgtcggtccgggggaccaccggaacggcccgggtaccccgtcggggtccgtccggtacccggtcggtaacccgg

SEQ ID NO: 373281 - DNA, 642 bp, Homo sapiens
  misc_feature: GZ8MTXP02J2FMT.15.87.H10.1.454.CMB.2.raw
  modified_base (374)..(374): a, c, t, g, unknown or other
  modified_base (384)..(384): a, c, t, g, unknown or other
  modified_base (626)..(626): a, c, t, g, unknown or other
tcagtctacgtagccacgaccggtgctcgatttagcagtactgcgttgggttttccttgttgctattttagaaggtgtccattgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaaagatggaagtgaagaaatactatgtggactctgtgaagggccgattcaccatctccagagacaacgccaaagaacttactgtatctagacaaaatgaaacagccgtagaggagggcgaaggacaccggctntgtattacgngtgcgagtactacctctcgtcgggccggtccgtacggtttcccgtacggctagtcggtacggtcggtcggggaccgaacgggacccgtaccggtcctacccggtcctcctcgaccgccctacccgaaccgaaccggccccgtacgtcccggttccccttcccccgtcggacccctacccctccctaccgaacgacgaccctaccgtcggcgggggaccacgaacggcccggccggtcgggcncggtccgtcggaaccg

SEQ ID NO: 373282 - DNA, 580 bp, Homo sapiens
  misc_feature: GZ8MTXP02JKARS.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatctttaatagtttttggatgacctgggtccgccagggtccagggaaggggctggagtgggtggccaaacataaagcaaagatggaagtgagaaatactatgtggactctgtgaagggccattcacatctcagagacaacgccaaagaacttactgtaatctgacaaaatgaaacagcctgagaggcgaaggacaccggctctgtattactgtgcgaggatacctctgtggcggctagttcctacggcaagtggacgtcgtcgggggaccgaaacgggaccgacggtcacccggtctcctcacgccctacccgaaccgaacgggcccagtccggtccttcccccgtggcccaccctcctacccaagacgccacctcgacggggcacgaacgcgccgtcggctcgccgtgtacg

SEQ ID NO: 373283 - DNA, 652 bp, Homo sapiens
  misc_feature: GZ8MTXP02JBVTV.15.87.H10.1.454.CMB.2.raw
  modified_base (324)..(324): a, c, t, g, unknown or other
  modified_base (374)..(374): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtcccctgagactctcctgtgcagcctctggattcatctttaatagtttttggatgacctgggtccgccagggtccaggggaaggggctggagtgggtggccaacataaagcaagatggaagtgagaaaatactatgtggactctgtgaagggccgattcaccatctccagagacaacgccaagaacttacngtatctgcaaatgaacagcctgagaggcgaggacacggctctgtattacngtgcgagatacctcctcgtggccgggcctaggtttcccacgggcagtggacgtcgtcgggggaccgaaggggaccacgggtccacccggtccctccgtcgaccgtccctacccgaaccggaccggccctacggttcccggttcccccttccccgtccggacccctacccccttaccctaccgaaacggccgaccctacccgttccgggtaccgggggacccaaccggccggccccggtcccggtcgggtccgtccggtaccggttacggtaaacccgg

SEQ ID NO: 373284 - DNA, 615 bp, Homo sapiens
  misc_feature: GZ8MTXP02HRVR2.15.87.H10.1.454.CMB.2.raw
  modified_base (299)..(299): a, c, t, g, unknown or other
  modified_base (324)..(324): a, c, t, g, unknown or other
  modified_base (328)..(328): a, c, t, g, unknown or other
  modified_base (342)..(342): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctgggagtgggtgccaaacataaagcaagatggaagtgaagaaatactatgtggactctgtgaagggccgattcaccatccnccagagacaacgcaaagaacttacngtanctgacaaatgaacngcctgagaggcgaggacaccggctctgtattactgtgcgaggactacctcctcgtgggccgggccgtacggtttccgtacggcagtcggacgtcgtcgggggaccgaacgggaccgaccggtccgacccgtcctcctcgacgccctcccgaacccgaacggaccccgacgtcccggtcccttcccccgtcggccctacccctccctacccaacgacgccacccgtccgtcggggaccacgcggccggcccgtcgggcgtcgtccgtcggtacg

SEQ ID NO: 373285 - DNA, 610 bp, Homo sapiens
  misc_feature: GZ8MTXP02FFAGP.15.87.H10.1.454.CMB.2.raw
  modified_base (321)..(321): a, c, t, g, unknown or other
  modified_base (377)..(377): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgaagaaatactatgtggactctgtgaagggccattcacatctccagagacaacgccaaagaactttacngtatctgacaaatgaacagcctggagaggcgaaggacaccggctctgtaattacgngtgccgaggactacctccgtctggggccggtcgtacgtttccgtacggcagtggacgtcgcggggcgaacgggacgacggtcaccgtctcctcacgcctaccgaaccgaccggcccacgtccggttcccttccccgtcggacccacccctccctaccgaacgacgaccgaaccttcggacgggggccaccgaacggtccggccccgggtcggccgtcggaccgtacggtaacg

SEQ ID NO: 373286 - DNA, 626 bp, Homo sapiens
  misc_feature: GZ8MTXP02IH66S.15.87.H10.1.454.CMB.2.raw
  modified_base (234)..(234): a, c, t, g, unknown or other
  modified_base (317)..(317): a, c, t, g, unknown or other
  modified_base (362)..(362): a, c, t, g, unknown or other
  modified_base (380)..(380): a, c, t, g, unknown or other
  modified_base (400)..(400): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcattctttaatagtttttggatgacctgggtccgccagggtccagggagggctggagtgggtgccaanataaagcaagatggaagtgagaaatactatgtggactctgtgaaggccatcacatctacagagacaacgccaaagaacttacngtatctagacaaatgaaacagtcctagaagaggaccgaggaaccnccgtctctagtatagtgngcgagactaccctccgtcgngggcggtaccgtacgttccgacggcgagtcggacgtacggtacggggaccgaacgggaccgacgccgtacccgtcctcctacacgccctacccgaaccgaaccggacccacgtccggttcccttaccccgtccgaccctacccctacctaccgaaacgactaccgaccgtcggacggggaccaacgaacgtccgggcccggtcggccgtcggtaccgtacggtacg

SEQ ID NO: 373287 - DNA, 644 bp, Homo sapiens
  misc_feature: GZ8MTXP02JF1VL.15.87.H10.1.454.CMB.2.raw
  modified_base (274)..(274): a, c, t, g, unknown or other
  modified_base (293)..(293): a, c, t, g, unknown or other
  modified_base (316)..(316): a, c, t, g, unknown or other
  modified_base (370)..(370): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcatctttaatagtttttggatgacctgggtccgccagggtccagggaagggctggagtgggtggccaacataaagcaagatggaagtgaagaaatactatgtggactntgtgaaggccatcacatcncagagacaacgcaaagacttacngtatctgacaaatgaaacagcctgagaggcgaaggcaccggctctgtaattacnggtgcgaggtacttaccctccgtcgtacggggccgggtacccgtacggtttcccgtacggcgtagtcggtacgttcgtcgggggaccgaaacgggaccgaccggtacgacccgtcctacctccgaccgccctacccgaaccgaacgggcccgacgtccggtcccttcccccgtcggtaccctaccccctcccgtacccaaacgaccgaccgtacccgtccgtacgggggaccaccgaacggccggtcccgtcgggctcggccgtacggtaaccg

SEQ ID NO: 373288 - DNA, 606 bp, Homo sapiens
  misc_feature: GZ8MTXP02GXVU4.15.87.H10.1.454.CMB.2.raw
  modified_base (272)..(272): a, c, t, g, unknown or other
  modified_base (292)..(292): a, c, t, g, unknown or other
  modified_base (360)..(360): a, c, t, g, unknown or other
  modified_base (369)..(369): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtgccaacataaagcaagatggaagtgaagaaatactatgtggactntgtgaaggccatcaccatcnccagagacaacgccaaagaacttactgtatctgacaaatgaaacagcctgagagcgaggacacggctntgtattacngtgcgagactacctcctcgtgggcggcctacgttcctacggcagtcggacgtcgtcggggaccgaagggaccgacggtcaccgtcctcctccacgccctacccgaaccgaacgggcccacgtccggtcccttcccccgtcggacccaccccttccctacccgaaacgacgaccaacccgttcggtacgggggaccacgaacggcccggcccgtcggggcctcgccgtacggtaaccg

SEQ ID NO: 373289 - DNA, 565 bp, Homo sapiens
  misc_feature: GZ8MTXP02IA7V6.15.87.H10.1.454.CMB.2.raw
  modified_base (272)..(272): a, c, t, g, unknown or other
  modified_base (290)..(290): a, c, t, g, unknown or other
  modified_base (322)..(322): a, c, t, g, unknown or other
  modified_base (364)..(364): a, c, t, g, unknown or other
  modified_base (391)..(391): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtgccaacataaagcaaagatggaagtgagaaatactatgtggactntgtgaaggccatcaccanctccagagacaacgccaaagaacttactgtanctgacaaaatgaaacagcctgagaggcgaggacaccggctcngtattactgtgcgaggataccctcctntgggcgccagtttccacggcatggacgtcgtggggccaaagggaccacggtcaccgtctcctcacgcctccaccaacgggcccatccggtccttcccccgcggcccacccctcctaccaacgacgccacctcgcgggggcacgaacgccggcctcgggctcgaccgttggaccg

SEQ ID NO: 373290 - DNA, 766 bp, Homo sapiens
  misc_feature: GZ8MTXP02HAECD.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcattctttaatagtttttggatgaccgtgggtcccgccgagggtccgaaggggaaggggctgggaggtggggtcggaccaaacaataaagcaaagagtaggaaagtgaagaaatactatggtggactcgtgtaggaacgggcctattccaaccattcctaccgaagacgaaccaaccgccaaaagtaactttactgtaatcgtagacaaatgaaacagcctaggagaggcgaaggtacaccggcttcgtagtacttacgtggtgaccggaggtaacttacccgtccgttcgtcggggcccgggtacccggttacgggtttcccgtaaccggtcgtaacgtcgggtaccgtcggtcgggggacccgaaacggggtacccgaccggtaccgtacccggttcctccgtaccgaccgtaccccgtacccgaacccgaaccgggcccctacgttcccggttccccttcccccggtccggacccctacccccgttaccctacccgaaacggcccgtacccgtaccccggttccgggtaccgggggaccaaccggcgggcccgggtcccggttcggggaccgtccggtaccggtcgggtaaacccgg

SEQ ID NO: 373291 - DNA, 613 bp, Homo sapiens
  misc_feature: GZ8MTXP02GW33B.15.87.H10.1.454.CMB.2.raw
  modified_base (273)..(273): a, c, t, g, unknown or other
  modified_base (293)..(293): a, c, t, g, unknown or other
  modified_base (298)..(298): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaaagatggaagtgagaaatactatgtggactntgtgaaggccatcaccatcncaganacaacgcaaagacttactgtatctgacaaaatgaaacagcctagagaggcgaggacaccggctctgtattactgtgcgagactaccctcctcgtcgggccgggccgtacggttccgtacggcgagtcgggacgtcggtacgggggaccgaacggggacccgaccggtaccgtacccgtcctcctcacgccctacccgaaccgaccggcccacgttccggtcccttcccccgtcggcccacccctccctaccgaacgaccgccacccgtcggtcggggcaccggaacgccgcccgtcgggctcgcgtacggtaccg

SEQ ID NO: 373292 - DNA, 603 bp, Homo sapiens
  misc_feature: GZ8MTXP02JMB04.15.87.H10.1.454.CMB.2.raw
  modified_base (319)..(319): a, c, t, g, unknown or other
  modified_base (372)..(372): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaaggccattcaccatctccagagacaacgccaaagaacttacngtatctgacaaatgaacagcctgagaggcgaggacaccggctctgtattacgngtgcgaggactaccctcctcgtgggccgggccgtacggtttcctacggcagtgggacgtcgtcggggccgaacggggaccgacggtccaccgtcctcctcacgccctcccgaaccgaaacgggcccacgtccggtcccttcccccgtcggcccacccctccctaccaacgacgccacccgtcgtcgggggccaccgaacggccggcccgtcgggcctcggccgtcggtacg

SEQ ID NO: 373293 - DNA, 567 bp, Homo sapiens
  misc_feature: GZ8MTXP02JSB28.15.87.H10.1.454.CMB.2.raw
  modified_base (453)..(453): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcattcttaatagttttggatgactggtccgcagggtccgagggagggctggagtgggtggccaacataaagcaaagatggaagtgaagaaatactatgtggactctgtgaagggccgattcacctatctaccagacgacaacgccaaagaacttactagtatcagtacaaatgaaaccancctagaggaggacgaggacacggctcgtgtacttactggtgacgaggtactacccgtctcggtcgggcggggcccgtacgggtttcccacgggctacgtacgggacgttcgggg

SEQ ID NO: 373294 - DNA, 590 bp, Homo sapiens
  misc_feature: GZ8MTXP02IPWYL.15.87.H10.1.454.CMB.2.raw
  modified_base (269)..(269): a, c, t, g, unknown or other
  modified_base (289)..(289): a, c, t, g, unknown or other
  modified_base (314)..(314): a, c, t, g, unknown or other
  modified_base (536)..(536): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgcagggtccagggagggctggagtgggtggcaacataaagcaagatggaagtgagaaatactatgtggactntgtgaaggccgatcacatcncagagacaacgccaaagaacttacngtatctgacaaatgaacagcctgagaggcgaggacaccggctctgtattactgtgcggaggactacccgtcctcgtgggccgggccgtacggtttccacggcagtggtacgtcgtcgggggaccaacggggaccgacggtccaccgtctcctcacgccctccaacccgaacgggcccacgtccggtcccttcccccgtcggccctcccctcctccaaggacnccaccttcgcgggggcacgaacgccggtcccgcgggctcgccgtgggtaaaccg

SEQ ID NO: 373295 - DNA, 637 bp, Homo sapiens
  misc_feature: GZ8MTXP02IIB6B.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccgaaccgtggggggtccctgagactctcctgtgcagcctctggattcatcttaattagttttgatgacgtggtccgcgaggtccgagggagggcgtggaggtgggtggaccaacaagtaaagacaaagagtaggaaagtagaagtaaataacgtagtggtaggacgttcgtggtaggaaacggggtccgtagtttaccaccgtatcccgtaccaggaacgacaaaccgaccaaaagtaaactttactagtaactactaacaaatacggaaacagccgtaagagggacggacgacggaacgacggtactcgttagtacttacgtgtacgacgtaggacttaccgtccgtacgtcgggccggaccgtaacggtttcccgacggtaccaggtcggacggttcgaaccggggg

SEQ ID NO: 373296 - DNA, 629 bp, Homo sapiens
  misc_feature: GZ8MTXP02JBG1X.15.87.H10.1.454.CMB.2.raw
  modified_base (233)..(233): a, c, t, g, unknown or other
  modified_base (270)..(270): a, c, t, g, unknown or other
  modified_base (288)..(288): a, c, t, g, unknown or other
  modified_base (293)..(293): a, c, t, g, unknown or other
  modified_base (311)..(311): a, c, t, g, unknown or other
  modified_base (330)..(330): a, c, t, g, unknown or other
  modified_base (365)..(365): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgcagggtccagggagggctggagtgggtgccaanataaagcaagatggaagtgagaaatactatgtgactntgtgaaggcatcacatcncaganacacgccaaagtactacngtatctagacaaatgaacngctgagagcgaaggacaccggctctgtaacttacnggtgcggtagactacccgtctcggtcggccggaccgtacgttcctacggctacgtggtacgtcgtcggggaccgtaaacgggaccgtacggtacctacccggtcctccgtaccaccgccctacccgaaccgaaccgggacccgacgttcccggtcccttcccccgtcggccctaccccctcctaccgaacgacgaccctaccgtccggtaccggggcaaccgaacggcccggtcccggtcggggcctcggtccgtcggtaaccg

SEQ ID NO: 373297 - DNA, 672 bp, Homo sapiens
  misc_feature: GZ8MTXP02HJTU1.15.87.H10.1.454.CMB.2.raw
  modified_base (238)..(238): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgccagggtccaggggaagggctggagtgggtggccaaanaataaagcaaagataggaagtagaagtaaatactagtggtggactctgtaggaaggccatcacatcacaagagaacaacgaccaaagtaacttactagtatctagacaaaatagaaacagtaccgtagaaggaggacggaaggacgacccggctacgtagttaacttacgtggtacgacggaacgtaacttaccctccgtcggtcgggaccgggtaccgttacggtttaccgtacggtactagtcgggtacgttcggtacggggaccgaaacgggaccgtacggtacctaccgtcctcctacacgccctaccgaaccgaacggacccacgtcccggtcccttccccgtcgacccacccctacctaccgaaacgacgacctacccgtccgtacgggacgacgaacgccggccgtcggcgtcgtccgtacggtacg

SEQ ID NO: 373298 - DNA, 628 bp, Homo sapiens
  misc_feature: GZ8MTXP02GWBN5.15.87.H10.1.454.CMB.2.raw
  modified_base (235)..(235): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcattctttaatagtttttggatgacctgggtccgccagggtccagggaagggctggagtgggtgccaanataaagcaagatggaagtgaagaaatctatgtggactctgtgaaggccattcaccatctccagagacaacgccaaagaacttactgtatctgacaaatgaacagcctgagaggcgaggacacggctctagtattactgtgcggaggacttaccctccgtcgtcgggcgggtacccgtacggtttccgtaacggcagtcggacgtcgtcgggggaccgaaacgggacccgaccggtccgacccgtcctccctacgcgccctaccgacccgaaccgggccctacgtccggttccccttcccccgtcggtacccacccccgttacccacccaacgacgaccacccgtcgtcggggccaccgaacggccggtcccgcggcgtcgccgtacggtaccg

SEQ ID NO: 373299 - DNA, 598 bp, Homo sapiens
  misc_feature: GZ8MTXP02F5CUX.15.87.H10.1.454.CMB.2.raw
  modified_base (233)..(233): a, c, t, g, unknown or other
  modified_base (317)..(317): a, c, t, g, unknown or other
  modified_base (370)..(370): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtgccaanataaagcaagatggaagtgagaaatactatgtggactctgtgaagggccattcaccatctccagagacaacgcaaagacttacngtatctgcaaaatgaacagcctgagaggcgaggacaccggctctagtattacngtgcgagactacctcctcgtggcgggcctacggttcctacggcagtggacgtcgtcggggaccgaacggggacccgaacggtccacccggtcctccgtcacgccctaccaccgaacggcccacgtccggttccttcccccgtcggccctaacccctccctaccgaacgacgccaccgtcgtcgggggccacgaacgccggcccgtcgggcctcggtcccgtggtaccg

SEQ ID NO: 373300 - DNA, 600 bp, Homo sapiens
  misc_feature: GZ8MTXP02HI0A5.15.87.H10.1.454.CMB.2.raw
  modified_base (376)..(376): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaagggctggagtgggtggccaacataaagcaagatggaagtgagaaatactatgtggactctgtgaagggccattcaccatctccagagacaacgccaaagaactttactgtatctgacaaaatgaaacagcctgagaggcgaggacaccggctctgtattacngtgcgagactaccctctgtgggccgggcctacggtttccacggcagtggacgtcgtcggggaccgaacgggaccgacggtcaccgtctcctcacgccctaccaccgaacggcccacgtccggtccttcccccgtcggccctacccctcctacccaaggacgccgaccgtcggtcgggggaccaccgaacggccggcccgtcgggccgtcggccgtacggtaccg

SEQ ID NO: 373301 - DNA, 589 bp, Homo sapiens
  misc_feature: GZ8MTXP02JOAZA.15.87.H10.1.454.CMB.2.raw
  modified_base (317)..(317): a, c, t, g, unknown or other
  modified_base (370)..(370): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaaggccatcaccatctccagagacaacgccaaagacttacngtatctgacaaaatgaacagcctgagaggcgaggcaccgggctctgtattacngtgcgaggataccctctcgtgggccggcctacgttcctacggcagtcggacgtcgtcggggaccgaacgggaccgacggtcgaccgtctcctcacgccctccgaccgaacggcccacgtccggtcccttcccccgtcggcccaccccgtccctaccaacgacgccaccgtccgtcgggggccaccgaacgccggcccgtcgggcgtcgccgtcggtacg

SEQ ID NO: 373302 - DNA, 635 bp, Homo sapiens
  misc_feature: GZ8MTXP02JDS67.15.87.H10.1.454.CMB.2.raw
  modified_base (278)..(278): a, c, t, g, unknown or other
  modified_base (295)..(295): a, c, t, g, unknown or other
  modified_base (300)..(300): a, c, t, g, unknown or other
  modified_base (319)..(319): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgccagggtccagggaaggggctggagtgggtggccaacataaagcaagatggaagtgagaaatactatgtggactctgnggaaggcatcaccatcncaganacaacgccaagaacttacngtatctgacaaatgaacagcctgaggaggcgaggacaccggctctagtacttactgtgcggaggactaccctccgtcgtcgggccgggtccgtacggtttccgtacggctagtcgggtacgtcggtcggggaccgaacggggaccgaccggtccaccgttcctcccgtcgacgccctcccgaccgaaccggcccacgttccggtcccttcccccgtcggacccctacccctaccctaccgaacgacgacctacccgtcggtccgggggccacgaacggcccggtcccgtacgggcctcggtccgtacggtaaccgg

SEQ ID NO: 373303 - DNA, 616 bp, Homo sapiens
  misc_feature: GZ8MTXP02H7W8M.15.87.H10.1.454.CMB.2.raw
  modified_base (341)..(341): a, c, t, g, unknown or other
tcagtctacgtagccacgaccggtgctcgatttagcagtactgcgttgggttttccttgttgctatttttagaaggtgtccagtgtgaggtgcagttggtggagtctggggggaggcttggtccaacctggggggtccctgagactctcctgtgcagcctctggattcattctttaatagtttttggatgacctgggtccgccagggtccagggaagggctggagtgggtggccaacataaagcaaagatggaagtgaagaaatactatgtggactctgtgaggccattcaccatctccagagacaacgccaaagaacttactgtatctgacaaatgaacngcctgagaggcgaggacacggctctgtattactgtcgcgaggtactacccttcctcgtggggccgggtcccgtacggtttccgacggcatcgggacgtcgtcgggggccgaacgggacccgacgtccgacccggttcctccctcgacgccctccaacccgacggccccacgtcccggtcccttcccccgtcgccctacccctccctacccgaaacgacgcccaccgtcgtcggggcaccgaacggccggcccgtcgggctccgcgttacggaccg

SEQ ID NO: 373304 - DNA, 595 bp, Homo sapiens
  misc_feature: GZ8MTXP02JWOQ6.15.87.H10.1.454.CMB.2.raw
  modified_base (340)..(340): a, c, t, g, unknown or other
  modified_base (363)..(363): a, c, t, g, unknown or other
  modified_base (378)..(378): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatctttaatagtttttggatgacctgggtccgccagggtccagggaaggggctggagtgggtggccaacataaagcaaagatggaagtgagaaatactatgtggactctgtgaaggccgattcaccatctccagagacaacgccaaagacttactgtatctgcaaaatgaacngcctgagaggcgaggacaccggntctgtattactggtncgaggataccctctcgtgggccgggccctaggtttcctacggcagtcggacgtcgtcggggccaacggggaccacgggtccaccggtctccgtcacgcctccaccaacgggcccatccggtcccttcccccgtcggcccacccctccctaccgaacgacgccaccgtccgcgggggccacgaacggccggcccgtcgggcctcggccgtcggtaccg

SEQ ID NO: 373305 - DNA, 600 bp, Homo sapiens
  misc_feature: GZ8MTXP02HYVJD.15.87.H10.1.454.CMB.2.raw
  modified_base (271)..(271): a, c, t, g, unknown or other
  modified_base (292)..(292): a, c, t, g, unknown or other
  modified_base (317)..(317): a, c, t, g, unknown or other
  modified_base (321)..(321): a, c, t, g, unknown or other
  modified_base (337)..(337): a, c, t, g, unknown or other
  modified_base (361)..(361): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgcagggtccagggaaggggctggagtgggtgccaacataaagcaagatggaagtgagaaatactatgtggactntgtgaaggccattcaccatcncagagacaacgccaaagaacttacngtanctagcaaaatgaaacngcctgagagcgaggacacggctcngtattactgtgcgagactacctcctgtgggcggtccgacgttccctacggcagtggacgttcgtcggggaccgaaacgggaccgacggtaccaccggtcctcctcgacgccctaccaacccgaacgggcccacgtccggtccttcccccgtcggacctacccctcctacccaaacgacgcctaaccctccgtacggggccacgaacggcccggccgtcgggcctcggccgtacggtacg

SEQ ID NO: 373306 - DNA, 773 bp, Homo sapiens
  misc_feature: GZ8MTXP02JW4B1.15.87.H10.1.454.CMB.2.raw
  modified_base (203)..(203): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttgggtccaaccgtgggggggtccctgagactctcctgtgcagcctctggattcattctttaatagtttttggatgacctgggtccncgagggtccaggggaagggctgggagtgggtcggaccaaacaataaagcaaagagtagggaaagtgaagtaaattactagtggtaggactcgtggtaggaaacgggccgaattcaacctatcctaccgaagacgaacaacgaccaaagtaactttactgtactacgtagaacaaaatacgaacacgaccgtaggaaggagggaccggaacggaccgaccggtctacttgttaacgttacgtggtacgacgaggtaacctcccgtccgtggttcgggccgggtacccgtacggtttacccgtacggcgtaggtcgggtacggtacggtacgggggaacccgaaacggggaccctaccgggtaccctacccgtcctacccgtccgaccgaccctacccggaaaccgaccgggtccccctacggttccccgttccccgttcccccgtccggtaccccctaccccgttaccaaccgaaacgacccgtaccgtaccggtccggggtaaccggggcccaacgggtcccgggcccggtcccggtcgggtaccgtccggtaaccgtcgggtaaacccg

SEQ ID NO: 373307 - DNA, 584 bp, Homo sapiens
  misc_feature: GZ8MTXP02JBYFI.15.87.H10.1.454.CMB.2.raw
  modified_base (199)..(199): a, c, t, g, unknown or other
  modified_base (319)..(319): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcatctttaatagtttttggatgacctgggtccnccagggtccagggagggctggagtgggtgccaacataaagcaagatggaagtgaagaaatactatgtggactctgtgaaggacgattcaccatctccagagacaacgccaagaacttacngtatctgacaaatgaacagcctgagagcgaggacacggctctgtattacgtgtgcgagctacctcctgtgggccggccgtacggtttccgtacggcagtcggacgtcgtcggggaccgaacgggtaccgacggtccaccggtctccctcacgccctccaccgaacggcccacgtccgtccttcccccgtcgccctacccctcctaccgaacgacgccaccgtcgcgggggccacgcggccgccgtcggcgtcgccgtcggtaccg

SEQ ID NO: 373308 - DNA, 627 bp, Homo sapiens
  misc_feature: GZ8MTXP02G4699.15.87.H10.1.454.CMB.2.raw
  modified_base (235)..(235): a, c, t, g, unknown or other
  modified_base (272)..(272): a, c, t, g, unknown or other
  modified_base (291)..(291): a, c, t, g, unknown or other
  modified_base (337)..(337): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattctttaatagtttttggatgacctgggtccgccagggtccagggagggctggagtgggtgccaanataaagcaagatggaagtgagaaatactatgtgactntgtgaaggcatcaccatcncagagacaacgccaaagaacttactgtatctagacaaaatgaaacngcctcgagaggcgaggaccacggctcgtagtattacgtggtgcgaggacttaccctccgtcgtgggccgggtcccgtacggtttcccgtacggcagtcggacgtcggtcggggaccgaacggggacccgacgggtccgtaccgtcctaccgtcacgccctaccgaccgaaccggcccacgtccgtcccttcccccgtcggccctacccctccctaccgaacgaccgccacccgtccggcgggggccaccgaacgggcccggccggtcgggcgtccggccgtcggtaaccg

SEQ ID NO: 373309 - DNA, 664 bp, Homo sapiens
  misc_feature: GZ8MTXP02HVRE9.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgcagggtccagggagggctggagtgggtggccaacataaagcaagatggaagtgagaaatactatgtggactctgtgaaggccgattcaccatctccagagacaacgccaaagaacttactgtatctgacaaaatgaacagcctgagaggcgaggacaccggctctgtattactggtgcgaggactaccctccgtcgtcggggccggtcccgtacggtttcccgtacggcaggtcgggaccgtcgggtacgggggaccggaaacggggacccgaccggtaccgacccgtcctcctcgaccgccctacccgaaccgaaccgggaccccacgtcccggttccccgttcccccgtccgggacccctaccccctaccctaccccgaaacgaccgcccgtacccgtccggtcgggggacccaccgaacggcccggcccggtcgggccgtccggtccgttacggtaaccgg

SEQ ID NO: 373310 - DNA, 619 bp, Homo sapiens
  misc_feature: GZ8MTXP02GY21L.15.87.H10.1.454.CMB.2.raw
  modified_base (294)..(294): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgcagggtccagggagggctggagtgggtgccaacataaagcaagatggaagtgagaaatactatgtggactctgtgaaggccatcacatctccaganacaacgccaaagaacttactgtatctagacaaaatgaaacagcctagagaggcgaggacaccggctcgtgtattactgtagcgaggactaccgtcctcgtggggccggcctacggtttccgtacggcacgtgggaccgttcgtcggggaccgaacggggaccacgggtcctacccggtctccctcgacgccctaccaacccgaaccgggccctacgtccggtccctcccccgttcggaccctaccccgtcctaccaacgacgtccacccgtcggtcggggccacgaacggcccggtcccgtcgggcctcgccgttacggtaaccg

SEQ ID NO: 373311 - DNA, 595 bp, Homo sapiens
  misc_feature: GZ8MTXP02JZK7I.15.87.H10.1.454.CMB.2.raw
  modified_base (297)..(297): a, c, t, g, unknown or other
  modified_base (322)..(322): a, c, t, g, unknown or other
  modified_base (342)..(342): a, c, t, g, unknown or other
  modified_base (365)..(365): a, c, t, g, unknown or other
  modified_base (375)..(375): a, c, t, g, unknown or other
  modified_base (388)..(388): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaaacataaagcaaagatggaagtgaagaaatactatgtggactctgtgaagggccattcaccatcnccagagacaacgcaaagaacttacngtatctgacaaaatgaaacngcctgagagcgaggacacggctntgtatactgngcgagactcctcngtgggccggccgtacggtttcccgtacggctagtgggacgtcggtcggggaccgaaacgggaccgaccggtcaccgtctcctcacgccctccaccgaacggcccacgtccggtcccttccccgtcgcccaccccgtcctaccaacgacgccaccgtcgcgggggaccacgaacgcccgggccgtcgggcgtcggcccgtggtaccgg

SEQ ID NO: 373312 - DNA, 609 bp, Homo sapiens
  misc_feature: GZ8MTXP02F67HZ.15.87.H10.1.454.CMB.2.raw
  modified_base (297)..(297): a, c, t, g, unknown or other
  modified_base (324)..(324): a, c, t, g, unknown or other
  modified_base (382)..(382): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaaacataaagcaaagatggaagtgaagaaatactatgtggactctgtgaagggccattcaccatcnccagagacaacgccaaagaactttacngtatctgacaaaatgaaacagcctaggagaggcgaaggacaccggctctagtattacnggtgcggaagactaccctcctcgtggggccggtccgtacggtttccgtacggcagtggacgtcgtcggggaccgaacgggaccgacggtcaccgtcctcctcacgccctacccgaccgaaccggcccacgtccgtcccttcccccgtcggcccacccctcctacccgaacgacgccaccgtcgtcgggggcacgaacgccggccgtcggcgtcgccgtcggtaaccg

SEQ ID NO: 373313 - DNA, 595 bp, Homo sapiens
  misc_feature: GZ8MTXP02IH27N.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgaagaaatactatgtggactctgtgaaggccattcaccatctcagagacaacgccaaagaacttactgtatctgacaaatgaacagcctgagagcgagacacggctctgtattactgtgcgagataccctcctcgtggccggccgtacgtttccacggcagtggacgtcgtcggggaccgaacgggaccgacggtcaccgtcctcctcacgccctccaccgaacggcccactccggtccttcccccgtcggcccaccccgtccctacccaaacgacgaccgacccgtccgtacgggggccaccgaacggccggcccgtcgggaccgtcggccgtacggtaccg

SEQ ID NO: 373314 - DNA, 588 bp, Homo sapiens
  misc_feature: GZ8MTXP02HNISS.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaaggccgattcaccatctccagagacaacgccaagaacttactgtatctgcaaatgaacagcctgagaggcgaggacaccggctctgtattactgtgcgagataccctcctcgtggccggcctacggtttcctacggcagtggacgtcgtcgggggaccgaacggggaccgacggtccaccggtcctcctcgacgccctccaccgaacggcccacgtccgtcccttcccccgtcgcctacccctccctaccgaacgacgccacctccgtcgggggccacgaacgcggcccgtcggcgtcgccgttcggaccg

SEQ ID NO: 373315 - DNA, 727 bp, Homo sapiens
  misc_feature: GZ8MTXP02JUC65.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgccagggtccagggaagggctggagtgggtggccaacataaagcaagatggaagtgaagaaatactatgtggactctgtgaagggccattcaccatctccagagacaacgccaaagaacttactgtatctgacaaatgaaacagcctaggaggacggcgaaggaccaccgggtctcgtagttaactttacgtggttcggcggtaacgggtaacttaccccgttcccgtcggtcgggggacccggggtacccgttacggggttttccccgtaaccggtccgtaaggttcggggaaccgttccgggtacgggggacccgtaaacgggggacccgtaccgggtcccaacccggttccctacccgtccgacggtccccctacccgaaacccggaaccgggaccccctacgttcccggttccccttccccccgtcggcccctacccccttccctacccgaaacgccgcccacccgtccggcggggaccaacggccggcccggccgtcggggcctcggtcccgtaggtaacccg

SEQ ID NO: 373316 - DNA, 601 bp, Homo sapiens
  misc_feature: GZ8MTXP02F5PW2.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatcttttaatagtttttggatgacctgggtccgccagggtccagggaagggctggagtgggtggccaacataaagcaagatggaagtgaagaaatactatgtggactctgtgaagggccgattcaccatctccagagacaacgccaaagaacttactgtatctgacaaaatgaaacagcctgagaggcgaggacaccggctctgtattactgtgcgagactaccgtcctgtgggccgggcctacggtttcctaccggcacgtggacggtcgtcgggggaccgaacgggacccgacggtccaccgtctcctcacgccctaccaccaacgggcccagtccggtccttcccccgtcgcccaccctcctaccaacgacgccacccgtcggtacgggggccacgaacggccggcccgtcggggcctcgccgtcggtaccg

SEQ ID NO: 373317 - DNA, 613 bp, Homo sapiens
  misc_feature: GZ8MTXP02JUO7W.15.87.H10.1.454.CMB.2.raw
  modified_base (304)..(304): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgccagggtccagggaaggggctggagtggggtggccaacataaagcaagatggaagtgagaaatactatgtggactctgtgaagggccgattcacatctccaganacaacgccaaagaacttactgtatctgacaaaatgaacagcctgaggaggcgaggacacggctctgtattactgtgcgaggactaccctcctcgtcggggccgggtccgtacgggtttcccgtacggcacgtcgggacgtcgtcggggaccgaacgggaccgacggtccgacccgtcctcctcacgccctaccaaccgaacggacccacgtcccggtccttcccccgtcgcccacccctccctacccaacgaccgccacccgtcggcgggggccacgaacggccggccgttcggctcgccgtcggtacg

SEQ ID NO: 373318 - DNA, 592 bp, Homo sapiens
  misc_feature: GZ8MTXP02JX7SF.15.87.H10.1.454.CMB.2.raw
  modified_base (321)..(321): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccgattcaccatctccagagacaacgccaaagaacttacngtatctgcaaatgaacagcctgagaggcgaggacacggctctgtattactgtgcgaggactaccctcctcgtggggccgggccgacggtttccgtacggcgagtggacgtcgtcgggggccgaacgggaccgacggtcgaccgtctcctcacgcctccaccgaacggcccaacgtccggtccttcccccgtcggccacccctccctcccaacgacgccaccgtcgtcgggggccacgaacgccggcccgtcgggcctcgccgtcggtaccg

SEQ ID NO: 373319 - DNA, 590 bp, Homo sapiens
  misc_feature: GZ8MTXP02JMMB9.15.87.H10.1.454.CMB.2.raw
  modified_base (278)..(278): a, c, t, g, unknown or other
  modified_base (296)..(296): a, c, t, g, unknown or other
  modified_base (301)..(301): a, c, t, g, unknown or other
  modified_base (379)..(379): a, c, t, g, unknown or other
  modified_base (526)..(526): a, c, t, g, unknown or other
  modified_base (531)..(531): a, c, t, g, unknown or other
  modified_base (577)..(577): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatcttttaatagtttttggatgacctgggtccgccaggggtccaggggaaggggctgggagtgggtggccaaacataaagcaagatggaagtgaagaaatactatgtgactntgtgaaggcatcacatcncaganacaacgccaaagaacttactgtatctagacaaaatgaaacacgcctagagaggcgaaggacaccggctctgtattacngtcgcgagtactaccctcgtcgtcgggccgggccgtacggttcccgtacggctagtcggtacgtcggtacggggaccgaacgggaccgacggtaccgaccgtcctccgtcacgccctaccaccgacgcccacgtccgtcctccccgngcccnccctcctaccacgcaccgaccgtcgcgggcacgcgccgccgcggcncgccgtggtaccg

SEQ ID NO: 373320 - DNA, 578 bp, Homo sapiens
  misc_feature: GZ8MTXP02I96T8.15.87.H10.1.454.CMB.2.raw
  modified_base (321)..(321): a, c, t, g, unknown or other
  modified_base (372)..(372): a, c, t, g, unknown or other
  modified_base (512)..(512): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaaagatggaagtgagaaatactatgtggactctgtgaaggccattcaccatctccagagacaacgccaaagaacttacngtatctgcaaaatgaacagcctgagaggcgaggacacggctctgtattacngtgcgagactaccctcctcgtgggccgggccgtacggttccgtacggcagtggacgtcgtcggggaccgaacgggaccgacggtcaccgtcctcctcacgcctccaccgacggcccacgtccgtccttccccgtcggccnccctcctaccacgacgccaccgtcgtcggggcacgaacgcggccgtcggcgtcgccgtacggtacg

SEQ ID NO: 373321 - DNA, 603 bp, Homo sapiens
  misc_feature: GZ8MTXP02IR5AU.15.87.H10.1.454.CMB.2.raw
  modified_base (234)..(234): a, c, t, g, unknown or other
  modified_base (274)..(274): a, c, t, g, unknown or other
  modified_base (293)..(293): a, c, t, g, unknown or other
  modified_base (315)..(315): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaagggctggagtgggtgccaanataaagcaagatggaaagtgaagaaatactatgtggactntgtgaaggccatcacatcncagagacacgccaagacttacntatctgacaaatgaacagcctgagaggcgaggacacggctcgtgttattacgtgtcgcgaggacttaccccgtcgtcgtggggccgggtccgtacgggtttcctacggtcacgtggtacgtcgtcgggggaccgaacgggaccacggtccaccgtcctccgtcacgccctccaaccgaccggcccacgtcccggtcccttcccccgtacggccctacccctccctaccgaacgacgccacccgtcgtcggggccacgaacgccggccgtcggctcgccgtggtaaccg

SEQ ID NO: 373322 - DNA, 627 bp, Homo sapiens
  misc_feature: GZ8MTXP02IO24S.15.87.H10.1.454.CMB.2.raw
  modified_base (324)..(324): a, c, t, g, unknown or other
  modified_base (344)..(344): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaattagtttttggatgacctgggtccgccagggtccagggaagggctggagtgggtggccaaacataaagcaagatggaagtgagaaatactatgtggactctgtgaagggccgattcaccatctccagagacaacgccaaagaacttacngtatctgacaaaatgaaacngcctgagaggcgaaggacacggctctgtattactgtgcgaggtactaccctcctcgtcgggcgggtcctacggtttccctacggcgacgtggtaccgtcggtcggggaccgaaacggggaccgaccgggtccgacccgtcctcctccacgccctacccgaacccgaacgggccccacgttcccggtcccttcccccgtcggcccacccctccctacccaacgacgaccgaccgtcgtacggggccacgaacggccggcccgtcgggcgtcgccgtcggtaccg

SEQ ID NO: 373323 - DNA, 630 bp, Homo sapiens
  misc_feature: GZ8MTXP02I0UJP.15.87.H10.1.454.CMB.2.raw
  modified_base (300)..(300): a, c, t, g, unknown or other
  modified_base (327)..(327): a, c, t, g, unknown or other
  modified_base (380)..(380): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcattctttaatagtttttggatgacctgggtccgccagggtccaggggaagggctggagtggggtggccaaacataaagcaaagatggaagtgaagaaatactatgtggactctgtgaagggccatcaccatcnccagagacaacgccaaagaactttacngtatctgacaaaatgaacagcctgagaggcgaggacaccggctctgtattacngtgcgagactacctcctgtcgggcggccgtacgtttccgtacggcagtcggacgtcgtcggggaccgaacgggaccgacggtccacccgtcctccgtcgacgccctccgaccgaacgggcccacgtcccgtccgttcccccgtcggtcccacccctcccgtacccaaacgaccgacccgacccgttccggacgggggccaccggaaccggcccgggccccgtcggggccgtccggccgtacggtaacccg

SEQ ID NO: 373324 - DNA, 687 bp, Homo sapiens
  misc_feature: GZ8MTXP02GTYF2.15.87.H10.1.454.CMB.2.raw
  modified_base (289)..(289): a, c, t, g, unknown or other
  modified_base (307)..(307): a, c, t, g, unknown or other
  modified_base (332)..(332): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatctttaatagttttggatgactgggtccgcagggtccagggagggctggagtgggtgcaacataaagcaagatggaatgagaaatctatgtggactctgtgaaggccatcacatctcaganacaacgcaagaacttacngttatctagactaaaagtcgaaacncgcctaggacgtaaggcggaaggaccaccgggcttcgtagtacttacgtggtgcggtaaggacttacccgtccgtcggtggggccgggtaccgtacgggtttcccgtacggtcgtagtcggacgttcggtacgggggaccgaacggggtacccgtacggtaccgaccgttcctccgtacgacgtcccttaccgaaccgtaaccgggtcccctacgtcccggttacccttcccccgtacgggtaccctaccccgtcccgttaccgaacgtaccgtacccgtaccgtccggtacggggtccaccgtaacggcccggtacccggtcgggtccgtacggtacccgttacggtaacccgg

SEQ ID NO: 373325 - DNA, 622 bp, Homo sapiens
  misc_feature: GZ8MTXP02I4SO9.15.87.H10.1.454.CMB.2.raw
  modified_base (297)..(297): a, c, t, g, unknown or other
  modified_base (320)..(320): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgcagggtccagggaagggctggagtgggtggccaacataaagcaagatggaagtgaagaaatactatgtggactctgtagaagggccgatcaccatcncagagacaacgcaaagaactacngtatctgacaaatgaacagcctagagaggcgaggacaccggctgtagtattacgtgtgcgaggtactaccctccgtcgtgggccggtaccgtacggttcccacggcacgtcggacgtcgtcggggaccgaacgggacccgacggtcctaccgtcctcctcacgccctaccgaaccgtaacgggcccacgtcccggtccccttcccccgcgacccacccctaccctaccgaaacgaccgacctacccgtcggacggggaccaacgcggcccggcccgtcgggcctacggccgttacggaaccg

SEQ ID NO: 373326 - DNA, 590 bp, Homo sapiens
  misc_feature: GZ8MTXP02IA6DD.15.87.H10.1.454.CMB.2.raw
  modified_base (276)..(276): a, c, t, g, unknown or other
  modified_base (343)..(343): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctgggagtggggtggccaaacataaagcaaagatggaagtgagaaatactatgtggactntgtgaagggccgattcaccatctccagagacaacgccaaagaacttactgtatctgacaaatgaacngcctgagaggcgaggacacggctctgtattactgtgcgaggatacctcctcgtggccgggcctacggtttcctacggcagtggacgtcgtggggccgaagggaccgacggtcaccgtctcctcacgcctccaccgaacggcccactccggtccttcccccgtcggcccacccctccctaccaacgacgccacctcgtcgggggccaccgaacggccggcccgtcgggccgtcggccgttcggtaccg

SEQ ID NO: 373327 - DNA, 618 bp, Homo sapiens
  misc_feature: GZ8MTXP02IMUZ3.15.87.H10.1.454.CMB.2.raw
  modified_base (302)..(302): a, c, t, g, unknown or other
  modified_base (322)..(322): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctgggagtggggtggccaacataaagcaagatggaagtgaagaaatactatgtggactctgtgaaggccattcaccatctcaganacaacgccaaagaacttacngtatctgcaaatgaacagcctgagaggcgaggacaccggctctgtattactgtgcggagactacccgtcctcgtggggccgggtccgtacggtttccgtaccggtcacgtggtacgtcgtcgggggaccgaacggggacccgacggtcacccgtcctcctcacgccctaccaaccgaaccggcccacgtccggtccttcccccgtcggcccacccctccctacccaaacgacgaccacccgtccgtcgggggccacgaacggccggcccgtcgggccgtcggtccgtacggtaccg

SEQ ID NO: 373328 - DNA, 613 bp, Homo sapiens
  misc_feature: GZ8MTXP02JT3FA.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaaggccgattcaccatctccagagacaacgccaaagaactttactgtatctgacaaaatgaaacagcctgagaggcgaggacaccggctcgtgtattactgtgcgaggactacctcctcgtcggggccggccgtaggtttccctacggcagtcggacgtcgtcggggaccgaacgggacccgacggtccaccgtcctcctcgacgccctcccaccgaaccggcccacgtcccggtcccttcccccgtcggcccacccctccctacccgaacgacgacctacccgtccggtacgggggccacgcggcccggcccgtcgggcctcggccgtcggtaccg

SEQ ID NO: 373329 - DNA, 559 bp, Homo sapiens
  misc_feature: GZ8MTXP02F2GY7.15.87.H10.1.454.CMB.2.raw
  modified_base (374)..(374): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccaggggaaggggctggagtgggtggccaacataaagcaagatggaagtgagaaatactatgtggactctgtgaagggccattcaccatctccagagacaacgccaaagaacttactgtatctgcaaaatgaaacagcctgagaggcgaggacacggctctgtattacngtgcgaggatacctcctctgggcgggccaggtttcctacggcatggacgtcgtggggcaagggaccacggtcaccgtctcctcagcctccaccaacggcccactcggtctcccctcgccaccctcctccaacgacgcacctcgtcgggggcacgaacgcggcccgtcgggctcgccgtcggtacg

SEQ ID NO: 373330 - DNA, 598 bp, Homo sapiens
  misc_feature: GZ8MTXP02F1C9C.15.87.H10.1.454.CMB.2.raw
  modified_base (318)..(318): a, c, t, g, unknown or other
  modified_base (373)..(373): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggagggctggagtgggtgccaacataaagcaagatggaagtgagaaatactatgtggactctgtgaagggccattcaccatctccagagacaacgccaaagactttacngtatctgacaaatgaaacagcctggagaggcgaaggacaccggctctgtattacngtgcgaggactacctcctcgtgggccgggtaccgaggtttcctacggcagtggacgtcgtcggggccgaaacgggaccgacggtcaccgtcctcctacacgccctacccaccgaacgggcccacgtccggttcccttcccccgtcggccctacccctcctacccaacgacgccaccgtcgtacgggggccacgaacgccggcccgtcgggctcgaccgtggtacg

SEQ ID NO: 373331 - DNA, 555 bp, Homo sapiens
  misc_feature: GZ8MTXP02GLHR1.15.87.H10.1.454.CMB.2.raw
  modified_base (236)..(236): a, c, t, g, unknown or other
  modified_base (510)..(510): a, c, t, g, unknown or other
  modified_base (517)..(517): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccaggggtccagggaaggggctggagtgggtggccaanataaagcaagatggaagtgagaaatactatgtggactctgtgaagggccgattcaccatctccagagacaacgccaagaacttactgtatctgcaaatgaacagcctgagaggcgaaggacaccggctctgtattactgtgcgaggataccgtcctctggcgggcctaggttcccttacggcatggcgtactgggggccaaggggaccacggtcaccgtctcctcagccctccaccaacggcccacgtcgtcctccccctgcaccctcctccanacgcacnctcgggggcacgcgcggccctgggctcgccgtaggtcg

SEQ ID NO: 373332 - DNA, 627 bp, Homo sapiens
  misc_feature: GZ8MTXP02F8VEN.15.87.H10.1.454.CMB.2.raw
  modified_base (323)..(323): a, c, t, g, unknown or other
  modified_base (343)..(343): a, c, t, g, unknown or other
  modified_base (378)..(378): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaaatactatgtggactctgtggaagggccattcaccatctccagagacaacgccaaagacttacngtatctgacaaaatgaaacngcctgagaggcgaaggacaccggctctgtattacngtgcgagactaccctctcgtggggccgggccgtacggtttccgtacggcacgtcgggacgtcgtcgggggaccgaaacggggaccgaccggtccgaccgtcctcccgtcacgccctacccgaaccgaaccggcccacgtccggtcccttcccccgtcggccccaccctccctacccgaacgacgcccaacccgtccgtcggggaccaccgaacgcccggcccgcgggtccgtcggccgtacggtaaccg

SEQ ID NO: 373333 - DNA, 607 bp, Homo sapiens
  misc_feature: GZ8MTXP02I5T1N.15.87.H10.1.454.CMB.2.raw
  modified_base (232)..(232): a, c, t, g, unknown or other
  modified_base (292)..(292): a, c, t, g, unknown or other
  modified_base (318)..(318): a, c, t, g, unknown or other
  modified_base (369)..(369): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctaggtccgccagggtccagggagggctggagtgggtgccaanataaagcaagatggaaagtgagaaatactatgtggactctgtgaaggccattcaccatcnccagagacaacgccaaagaacttacngtatctgacaaatgaacagcctgagaggcgaggacacggctctgtattacngtgcgagactaccctctcgtgggccgggcctacggtttcctacggcagtggacgtcgtcggggaccgaacgggaccgacggtcaccgtctcctcacgtccctccgaacccgaacgggccctacgtccggtcccttcccccgtcggccctacccgtccctaccgaacgaccgaccacccgtcggtccgggggacaaccgcggcccggtcccgtacgggcctcggaccgttcggtaaccg

SEQ ID NO: 373334 - DNA, 609 bp, Homo sapiens
  misc_feature: GZ8MTXP02INJNH.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtcccctgagactctcctgtgcagcctctggattcatcttaatagttttggatgactggtccgccagggtccagggagggctggagtgggtggccaacataaagcaagacctggaagtgagaaatactatgtggactctgtgaaggccgattcacatctccagagacaacgccaagaacttactgtatctgacaaatgaacagcctagagaggcgaggacaccggctctgtattacgtgtgcggtagactaccctcctcgtggggccgggtccgtacggtttccgtacggcacgtgggtacgtgtcggggaccgaacgggaccgaccggactacccggtccttcctccgtacgccctcccgaacccgaaccggggcccctacgtccggtccttcccccgtcggcccacccctcctacccaacgcgaccaccgtccgtcggggcacgaacgccggccgtcggcgtcgccgtcggtacg

SEQ ID NO: 373335 - DNA, 596 bp, Homo sapiens
  misc_feature: GZ8MTXP02JGEHQ.15.87.H10.1.454.CMB.2.raw
  modified_base (321)..(321): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggagggctggagtgggtggccaacataaagcaagatggaagtgaagaaatactatgtggactctgtgaagggccgattcaccatctccagagacaacgccaaagaacttacngtatctgacaaaatgaacagcctgagaggcgaggacaccggctctgtattactgtgcgagactaccctcctcgtgggccggcgtacgttccgtacggcagtggacgtcgtcggggaccgaacgggaccgacggtcgaccgtcctcctcacgccctacccgaccgaaccggcccacgtccggtccttcccccgtcggcccacccctccctaccaacgaccgccaccgtcgtcgggggaccacgaacgccggcccgtcgggctcggccgtcggtacg

SEQ ID NO: 373336 - DNA, 638 bp, Homo sapiens
  misc_feature: GZ8MTXP02G97R1.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagcttgggttttccttgttgcttattttagaaggtgtccagtgtgaggtgcagttggtggagtcgtgggggaggcttggtccaaccgtggggggtccctgagactctcctgtgcagcctcgtggattcattctttaattagtttttggatgaccgtgggtccgccgaggggtccgaggggaaggggctgggaggtggggtcggaccaaacgataaagcaaggagtggaaagtgaagaaatacgtatgtaggactcgtgtaggaaacggggcccgtattccgaacctatccgtaccaagacgaacaaccgacccaaaagtaacttactagtaactctagaactaaaagtgaaacacggacctgggaaaggacggacggaggaaccagggtcttacgtagttactacgtgtcgcgaacggtactaccctccgtacgtcggggcccgtaaccgtcggtttacccgacggactacggtacgggtacgttcggg

SEQ ID NO: 373337 - DNA, 761 bp, Homo sapiens
  misc_feature: GZ8MTXP02JH0SP.15.87.H10.1.454.CMB.2.raw
  modified_base (238)..(238): a, c, t, g, unknown or other
  modified_base (308)..(308): a, c, t, g, unknown or other
  modified_base (328)..(328): a, c, t, g, unknown or other
  modified_base (381)..(381): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcattctttaatagtttttggatgacctgggtccgccagggtccaggggaaggggctggagtgggtggccaanataaagcaaagatggaaagtgaagaaaatactatgtggactctggtgaagggccattcaccatctcaganacaacgccaaagaacttacngtatctgacaaatgaacagcctgagaggcgaggacacggctcgtgtattacgnggtcgcggaggacttacccgtccgtacgtggggaccggggtccctaacggggttttcccgtaaaccgggctaggtacgggtaaccgttccggtacggggggtacccgaaaacgggggtacccgacccgggtaccgtaaccccggttcccttcccgtaccgtaccggacccccttaccccgaaaccccggaaaccgggggtccccctaacggttcccggttccccctttcccccccggttacgggccccctaacccccgttccccgtacccgaaaacggacccgtaccgaaccccggtttcgggaccgggggaccaaccggaacggcccccggggtcccggttccggggccgttccggtcccggtttacgggtaaacccgg

SEQ ID NO: 373338 - DNA, 604 bp, Homo sapiens
  misc_feature: GZ8MTXP02ILDW6.15.87.H10.1.454.CMB.2.raw
  modified_base (200)..(200): a, c, t, g, unknown or other
  modified_base (305)..(305): a, c, t, g, unknown or other
  modified_base (377)..(377): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcatctttaatagtttttggatgacctgggtccnccgagggtccagggaagggctgggagtgggtggccaacataaagcaagatggaagtgaagaaatactatgtggactctgtgaagggccgattcacatctccaganacaacgccaaagacttactgtatctagacaaatgaacagcctgagagcgaggacacggctctgtattactgngcgagacttacctcctcgtcgggccgggtcccgtacggttcctacggcagtcggacgtcgtcgggggaccgaacgggaccgacggtcaccggtcctcctcacgccctccaccgaaccggcccacgtccggtcccttccccgtcggccaccctcctacccgaacgaccgaccaccgtcggtcgggggccacgcggccggccgtcgggccgtcggacctcgggtaaccg

SEQ ID NO: 373339 - DNA, 709 bp, Homo sapiens
  misc_feature: GZ8MTXP02JP9MV.15.87.H10.1.454.CMB.2.raw
  modified_base (277)..(277): a, c, t, g, unknown or other
  modified_base (296)..(296): a, c, t, g, unknown or other
  modified_base (321)..(321): a, c, t, g, unknown or other
  modified_base (375)..(375): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgccgagggtccagggaagggctggagtgggtggccaacataaagcaagataggaagtgaagaaatactatgtggactntgtgaaggccatcacatcnccagacgacaacgcaaagacttacngtatctgacaaatgaacagctagagagcgaggacaccggctctagtacttacgnggtacgcggtaacggtacttaccccgtccgtcggtcgggggcccgggtacccgtaacgggtttcccgtaccggactaagtcgggtaaccgtcggtcgggggacccgaaacggggacccgaccgggtaccgtacccggtcctcccttccgaccgcccctacccgaacccgaaccgggacccctaacgttcccggtccccttcccccgtccggtacccctacccccgttacccctaacccgaaccgaaccgcccgtaaccccgtccggtaccgggggaccaccggaaccggcccggtccccggttcgggccgttccggcccggttacggtaaccgg

SEQ ID NO: 373340 - DNA, 695 bp, Homo sapiens
  misc_feature: GZ8MTXP02JSJBD.15.87.H10.1.454.CMB.2.raw
  modified_base (301)..(301): a, c, t, g, unknown or other
  modified_base (395)..(395): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattctttaatagtttttggatgacctgggtccgcagggtccaggggaaggggctgggagtgggtggaccaacataaagcaaagatggaagtgaagaaatactatgtggactctgtgaagggccatcaccatcnccagagacaacgaccaagtaactttactgtaatctgacaaaatcgaaacagcctggagacgggcgaagggacaccgggctcgttagtattacgngtgcgaaggtacttacccgtccgtgtcggggcccgggtaccgttacgggtttcccgaacgggtctaagttcgggacgttcggtacgggggacccgaaacgggggtacccaccggggtcctacccggtccttcccacgtaaccgccccgtacccgaaccggaaccggggtcccctaacgttccccggttccctttcccccgtcggccctaacccccttcccaccgaaacgtccgaccctaccggttccggcgggggaccacgccggccggtcccggtgggctccggtccgtacggtaaccg

SEQ ID NO: 373341 - DNA, 627 bp, Homo sapiens
  misc_feature: GZ8MTXP02INYR2.15.87.H10.1.454.CMB.2.raw
  modified_base (200)..(200): a, c, t, g, unknown or other
  modified_base (233)..(233): a, c, t, g, unknown or other
  modified_base (290)..(290): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcatctttaatagtttttggatgacctgggtccncagggtccagggagggctggagtgggtgccaanataaagcaagatggaagtgaagaaatactatgtggactctgtgaaggcatcacatcncagagacaacgcaaagaacttactgtatctgacaaaatgaacagcctgaggagcgaggacaccggctctgtattactgtgcgagactacctcctcgtggcggctacgttcctacggcagtcggacgtcgtcgggggaccgaaacgggaccgacggtcacccgtccgtcctcgacgcccgtacccaacccgaacgggcccacgtccgtcccttcccccgtcggaccctacccctccctaccgaaaccgacgacctacccgtaccggtcgggggaccaaccgccggtcccgggccccggtcgggggtcccgtaccggtcccggttacgggtaaacccgg

SEQ ID NO: 373342 - DNA, 562 bp, Homo sapiens
  misc_feature: GZ8MTXP02IORXP.15.87.H10.1.454.CMB.2.raw
  modified_base (65)..(65): a, c, t, g, unknown or other
  modified_base (454)..(454): a, c, t, g, unknown or other
  modified_base (479)..(479): a, c, t, g, unknown or other
tcagtctacgtagccacgaccggtgctcgatttagcagtactgcgttgggtttgggggtctcagngaggagccttagccctggactccaaggcctttccacttggtgatcagcactgagcacagaggactcaccatggaattgggactgagcgtggtttcctgtgctatttagaaggtgtccagtgtgagtgcagttggtggagtctgggggagcttggtccaacctggggggtccctgagactctcctgtgcagcctctggattcatctttaatagtttttggatgacctgggtccgccgagggtccagggaggggctggagtggtgccaacgataaagcaagatggaaagtgaagaaatcgtatgtggaactctggtgaaagggcccgtaattccgaccatcctccagagacaaacgccaaagtaacttactgtaatctgacaaatgaaacngcctgagacggcgaggactaccggntcgtagtacttacgtgtcgacgagtacctcccgtcgtcgtcgggccggtcgtacggttacctacggctacggtcggtacgtcg

SEQ ID NO: 373343 - DNA, 602 bp, Homo sapiens
  misc_feature: GZ8MTXP02FPQ3I.15.87.H10.1.454.CMB.2.raw
  modified_base (323)..(323): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgaagaaatactatgtggactctgtgaagggccgatcaccatctccagagacaacgccaaagaactttacngtatctgacaaaatgaacagcatgagaggcgaggaccacggctcgtgtattacgtgtgcgaggactaccctcctcgtcgggccgggccgtacggtttccctacggcagtggacgtcgtggggccgaagggaccgacggtccaccgtctccctcacgccctccacccgacgggcccacgtccggtcccttcccccgtcggtcccacccctcctacccaacgacgccaccgttccggcgggggccaacgacggccggtcccgtcgggcctcggccgtcggg

SEQ ID NO: 373344 - DNA, 687 bp, Homo sapiens
  misc_feature: GZ8MTXP02HBYDF.15.87.H10.1.454.CMB.2.raw
  modified_base (619)..(619): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtgggggtccctgagactctcctgtgcagcctctggattcattctttaattaggttttgatcgaccgtgggtccgccgacggggtccgaggggaaggggcgtgggaggtggggtcggaccaaacgaagtaaagcaaagagtaggaagtgaagaaatactatggtggacttcgtgtggaacgggtcctagttccaaccacgtcctaccgaagaaccgaaacaaccgacctaaaacgtaacctttaccgtaggttaactccgtagaacctaaaaatcgaaaaccgtacgtaccgtaggaagggacggaccggacggtaccgaacggtcttacgtagttaacgttaccgtggtacgacggtaacggtaccttaccccgtccgttccggngggggtaacccggtccgttaacggggtttccccgaagggtcctaacgttcggggaacgttcccggggg

SEQ ID NO: 373345 - DNA, 628 bp, Homo sapiens
  misc_feature: GZ8MTXP02J22B9.15.87.H10.1.454.CMB.2.raw
  modified_base (199)..(199): a, c, t, g, unknown or other
  modified_base (361)..(361): a, c, t, g, unknown or other
  modified_base (368)..(368): a, c, t, g, unknown or other
  modified_base (376)..(376): a, c, t, g, unknown or other
  modified_base (389)..(389): a, c, t, g, unknown or other
  modified_base (394)..(394): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccnccagggtccaggggaagggctggagtgggtgccaaacataaagcaaagatggaagtgaagaaatctatgtgactctgtagaaggccattcaccatctaccagagaccaacgccaaagtaacttctgtatctgacaaaatgaacagcctagagagcgaggacnccggctntgtattcngtgcgagactccnctcgnggccggcacgttccgacgcagtcggacgtcggtcgggaccgaacggaccgacggtccaccgtctcctcacgccctacccgaccgaacgcccgtacgtcccggttcccttcccccgtcgtaccccaccccgttacccacccgaaccggaccgtacccgtacccgtccggaccgggggacccaaccggccggcccggtcccggtcgggtacccgtccggtccgtacggtaacccgg

SEQ ID NO: 373346 - DNA, 595 bp, Homo sapiens
  misc_feature: GZ8MTXP02JLL51.15.87.H10.1.454.CMB.2.raw
  modified_base (236)..(236): a, c, t, g, unknown or other
  modified_base (302)..(302): a, c, t, g, unknown or other
  modified_base (307)..(307): a, c, t, g, unknown or other
  modified_base (324)..(324): a, c, t, g, unknown or other
  modified_base (370)..(370): a, c, t, g, unknown or other
  modified_base (378)..(378): a, c, t, g, unknown or other
  modified_base (380)..(380): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtcccaaccgtgggggggtccctgagactctcctgtgcagcctctggattcattcttttaattagtttttggatgacctgggtccgccgagggtccaggggaagggctggagtgggngccaacataaagcaagatggaagtgaagaaatactatgtggactctgtgaagggcattcaccatcncaganacaacgcaaagacttangtatctagacaaaatgaacagcctagagaggcgaggacaccggctntgtattcngngcgagactccctctgcgggcggtaccgtacggttcctacggcagtcgggtacgtcgcgggggacgaacggggaccacggtccaccgtctcctcacgccctaccgaccgaacggcccagtcccggtcctccccgtcgcccacccgtccctaccgaacgacgccaccgtccggcggggccacgaacggccggccgtcgggctcggcgtcggtaaccg

SEQ ID NO: 373347 - DNA, 660 bp, Homo sapiens
  misc_feature: GZ8MTXP02G6NL1.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtgggggtccctgagactctcctgtgcagcctctggattcattctttaattagttttggatgaccgtcgggtccgccgagggtccgaggggaaggggcgtgggaggtggggtacggaccaaaacgaagtaaaagacaaaggaagtagggaaagtagaacgtaaaatactatggtagacttcgtggtagaacgggccgtattccaccatcctaccaagaacgaaccaaacgacccaaaagtaacttacgtagtaactccgtagacctaaaaatcggaaacagtccgtaggaggaacggacggaaggtaccgacggcttacgtagttaaacttacgtggtcgacggtaggtaaaccttccccgttcgtcgtcggggcccggtaaccgttacggtttcccgacgggctaacggtcggtaaccggtcgggg

SEQ ID NO: 373348 - DNA, 570 bp, Homo sapiens
  misc_feature: GZ8MTXP02IVS2Z.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagttttggatgacctgggtccgccagggtccagggagggctggagtgggtggccaacataaagcaagatggaagtgagaaatactatgtggactctgtgaagggccgattcaccatctccagagacaacgccaagaacttactgtatctgcaaatgaacagcctgagagcgaggcacggctctgtattactgtgcgaggataccctcctctgggcgggcaggttcctacggcatggacgtcgtgggggccaagggaccacggtcaccgtctcctcacgccctccacccaacgggcccacgtccggtccttcccccgtcggccacccctccctccaaagacgccacctcgtcgggggccacgaacggccggcccgtcgggctcgccgtcggtaccg

SEQ ID NO: 373349 - DNA, 586 bp, Homo sapiens
  misc_feature: GZ8MTXP02GAMA5.15.87.H10.1.454.CMB.2.raw
  modified_base (329)..(329): a, c, t, g, unknown or other
  modified_base (354)..(354): a, c, t, g, unknown or other
  modified_base (377)..(377): a, c, t, g, unknown or other
  modified_base (539)..(539): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccaggggtccagggaagggctggagtgggtggccaacataaagcaagatggaagtgaagaaaatactatgtggactctgtgaaggccattcaccatctccagagacaacgccaaagaacttactgtatctnacaaaatgaaacagcctagagaggngaaggacacggctctgtattacngtgcgagactacctcctcgtggccgggcctacggtttcctacggtcgagtcggacgtcgtcggggaccgaaggggacccgacggtccaccgtcctcctcacgccctaccaccgaacggcccacgtccgtcctcccccgtcgccacccctcctaccaacgacnccacctcgcggggccacgaacgcgtcccgcggctcgcctcggtaacg

SEQ ID NO: 373350 - DNA, 592 bp, Homo sapiens
  misc_feature: GZ8MTXP02HO00M.15.87.H10.1.454.CMB.2.raw
  modified_base (273)..(273): a, c, t, g, unknown or other
  modified_base (289)..(289): a, c, t, g, unknown or other
  modified_base (291)..(291): a, c, t, g, unknown or other
  modified_base (296)..(296): a, c, t, g, unknown or other
  modified_base (312)..(312): a, c, t, g, unknown or other
  modified_base (318)..(318): a, c, t, g, unknown or other
  modified_base (340)..(340): a, c, t, g, unknown or other
  modified_base (360)..(360): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcattctttaatagtttttggatgacctgggtccgcagggtccagggaagggctggagtgggtgccaaacataaagcaaagatggaagtgaagaaatctatgtgactntgtgaggccatcacancncaganacaacgcaaagactangtatcngacaaatgaaacagcctgaagnggcgaggacaccggctactntaattactgtgcgaagactaccctcctcgtggcgggtaccgtacggtttcctacggcagtcggtacgtcgtcggggaccgaaacgggaccgacgtcgaccgttcctacctcgacgcccgtacccaccgaaccgggcccacgtccgtccttccccgtcgccaccctcccaccacggactccaccctcgcggggaccacgaacgcccggccgtcggcgttcgccgtggtaaccg

SEQ ID NO: 373351 - DNA, 595 bp, Homo sapiens
  misc_feature: GZ8MTXP02JBLBQ.15.87.H10.1.454.CMB.2.raw
  modified_base (318)..(318): a, c, t, g, unknown or other
  modified_base (370)..(370): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaaggccattcaccatctcagagacaacgccaaagaacttacngtatctgacaaaatgaacagcctgagaggcgaggacacggctctgtattacngtgcgagactaccctcctgtcgggccgggccgtacggtttccgtacggcagtcggacgtcgtcggggccgtaagggaccacggtcaccgtcctcctcacgccctaccacccgaacgggcccacgtccggttccttcccccgtcggcccacccctccctaccgaacgacgccacccgtcgcggggccacgaacggccggcccgtcgggctcgtccgtacggtaccg

SEQ ID NO: 373352 - DNA, 576 bp, Homo sapiens
  misc_feature: GZ8MTXP02JVTEO.15.87.H10.1.454.CMB.2.raw
  modified_base (375)..(375): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggttccctgagactctcctgtgcagcctctggattcatctttaatagtttttggatgacctgggtccgccagggtccagggaagggctggagtgggtggccaacataaagcaagatggaagtgagaaatactatgtggactctgtgaaggccgattcaccatctccagagacaacgccaaagaacttactgtatctgacaaaatgaaacagcctgagaggcgaggacaccggctctgtattacngtgcgagatacctctctgggcgggcctacggttcctacggcagtggacgtcgtcggggccgaacggggaccacggtcaccgtctcctcacgcctccaccgaacgggcccacgtccggtccttccccgtcggccaccctcctccaacgacgccaccgtcgtcgggggcacgaacgccggccgtcgggctcgccgtcggtacg

SEQ ID NO: 373353 - DNA, 665 bp, Homo sapiens
  misc_feature: GZ8MTXP02JZ15A.15.87.H10.1.454.CMB.2.raw
  modified_base (291)..(291): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaggccattcacatcncagagacacgccaagaacttactgtatctgactaaatgaacagcctgagagcgaggacacggtctctgtacttacgtggtgcgggtaaggtaccttacccgttcccgtcggttcggggacccggggtccgtacgggtttcccgtaccggtcgtacgtacgggaccgttcggtcgggggtaccgaacggggacccgaccgggtccaccgtcctcctacgcgccctaccgaccgacgggccctacgttcccggttcccgttacccccgtccgtcccacccctacccgtaccgaacgaccgccgtacccgtcggtccgggggaccaccggaacggcccggtcccgtcggggtccgtccggtaccgtcggtaacccgg

SEQ ID NO: 373354 - DNA, 633 bp, Homo sapiens
  misc_feature: GZ8MTXP02I3791.15.87.H10.1.454.CMB.2.raw
  modified_base (200)..(200): a, c, t, g, unknown or other
  modified_base (317)..(317): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtcccctgagactctcctgtgcagcctctggattcattctttaatagtttttggatgacctgggtccnccagggtccagggagggctggagtgggtggccaacataaagcaagatggaagtgagaaatctatgtgactctgtgaaggccattcaccatctccagacacaacgccaaagacttacngtatctgacaaatgaacagctgagaggcgaggacacggctgtgtattacgtgtagcgaggacttaccctccgtcgtggccgggtacctacgtttccgtacggcagtcggacgtcgtcggggccaacggggaccacggtccaccggtcttaccctcgacgccctaccaaccgaaccgggacccacgtccggttcccttcccccgtcggtacccctaccccctacccgtacccgaaacggccgaccgtacccgtcggtcgggggaccaccgaacggtcccggcccggtcggggtccgtacggcccgttcggtaaccgg

SEQ ID NO: 373355 - DNA, 593 bp, Homo sapiens
  misc_feature: GZ8MTXP02FL787.15.87.H10.1.454.CMB.2.raw
  modified_base (323)..(323): a, c, t, g, unknown or other
  modified_base (376)..(376): a, c, t, g, unknown or other
  modified_base (466)..(466): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaaacataaaagcaaagatggaagtgaagaaatactatgtggactctgtgaaggccgattcaccatctccagagacaacgccaaagacttacngtatctgacaaatgaaacagcctgagaggcgaggacaccggctctgtattacngtgcgagactacctcctctgggccgggcctaggtttcctacggcagtggacgtcgtggggccgaagggaccacggtcaccgtcctcctcncgccctccacccgaacggcccactccggtccttcccccgtgcccaccccgtcctccaaacgacgcccaaccgtccgtcgggggccacgaacggccggcccgtcggggcctcggcccgtggtaaccgg

SEQ ID NO: 373356 - DNA, 592 bp, Homo sapiens
  misc_feature: GZ8MTXP02GHY4R.15.87.H10.1.454.CMB.2.raw
  modified_base (381)..(381): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgccagggtccagggaaggggctggagtgggtggccaacataaagcaaagatggaagtgaagaaatactatgtggactctgtgaagggccattcaccatctccagagacaacgccaaagaactttactgtatctgacaaaatgaaacagcctagagaggcgaggacaccggctctgtattacngtgcgaggatacctctctgggccgggccacggtttccgtacggcagtggacgtcgtggggaccaagggaccacggcaccgtctcctcacgccctcccaccaaacgggcccacgtccggtccttcccccgtcgcccaaccccttcccaccaacgaacgcacccgtcgtcgggggcacgaacgccggcccgtcgggctcggcctcggtaaccg

SEQ ID NO: 373357 - DNA, 654 bp, Homo sapiens
  misc_feature: GZ8MTXP02IX6D3.15.87.H10.1.454.CMB.2.raw
  modified_base (320)..(320): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgcagggtccagggaagggctggagtgggtggccaacataaagcaagatggaagtgaagaaatctatgtggactctgtgaaggccgattcacatctccagagacaacgccaaagaactttacngtatctgacaaaatgaacagcctagagaggcgaggaccacggctctgtacttactggtgcgaggactaccctccgtcgtggggccgggccgtacgggtttcctacggctagtcggtacgtcgtcgggggaccgaaacggggaccgacgggtcctacccggtccttcccgtcgtacgtcccctaccgaacccgaacgggcccctacgtcccggttcccgttcccccgtacggcccctaacccctcccgtacccgaaacggaccgtccaccgttccggtcgggggaccaacgccggcccggtcccggtcggggccttccggaccgtcggtaaccgg

SEQ ID NO: 373358 - DNA, 743 bp, Homo sapiens
  misc_feature: GZ8MTXP02FP9G1.15.87.H10.1.454.CMB.2.raw
  modified_base (285)..(285): a, c, t, g, unknown or other
  modified_base (328)..(328): a, c, t, g, unknown or other
  modified_base (382)..(382): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattctttaatagtttttggatgaccgtgggtccgccgagggtccaggggaaggggctggaggtgggtggaccaaacataaagcaagataggaagtagaagaaatactatgtggactntgtgaagggccatcacatcacagagacaacgcaaagacttacngtatctgacaaatgaacagcctaggagaggcgaggacacggctctgtattacgngtgcggagtactaccctccgtcgtcggggccgggtaccctacgggtttccctaaccgggctaaggtcgggaaccggttcgggtacgggggaacccgaaacgggggacccgaccgggtccgtacccggttcctcccgtaccgaccggtcccctacccgaaaccccggaaacccggggtcccctaaccggttccccgggtttcccccgttccccccgtacgggtaccccctaacccccttccccgtaacccgaaacggacccgacccgtaaccccggtaccggggtccgggggaccaaccgggccggccccggggtccccggttcgggggcccgttaccgggcccggttacgggtaaacccgg

SEQ ID NO: 373359 - DNA, 587 bp, Homo sapiens
  misc_feature: GZ8MTXP02GDNLY.15.87.H10.1.454.CMB.2.raw
  modified_base (514)..(514): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcattctttaatagttttggatgaccgtgggtccgccgagggtccgaggggaggggctggaggtggggtggaccaaacaataaaggcaaagagtaggaagtgaagaaatactatgtggactgtgtagaagggcctattccactatcctccagacgacaacgacaaagtaacttactgtaactcgtagacaaaatgaaacacgccgtaggagaggcgaaggacacggtctcgtgtaattacgngtggcgaggtactaccctccgtcgtcgggccggtccgttacggtttcccgacggctacgtcgggtacgtcggg

SEQ ID NO: 373360 - DNA, 673 bp, Homo sapiens
  misc_feature: GZ8MTXP02IX8WR.15.87.H10.1.454.CMB.2.raw
  modified_base (325)..(325): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaagggctggagtgggtgccaacataaagcaagatggaagtgagaaatactatgtggactctgtgaaggccattcaccatctccagagacaacgccaaagaacttactgtatcngacaaatgaaacagcctgagaggcgaggacacggctctgtattactgtgcgagactaccctccctcgtgggccgggtcccgtagggtttccctacggcagtcgggaccgttcggtcgggggacccgaaacggggacccgaaccgggtcctaaccccggttccttccccgttccgaaccggtccccctacccgaaccccgaaaccgggggccccctaacgttcccgggttcccttccccccgtcggcccctacccccgttcccgtacccaaacggaccgcccaacccgttcggcgggggccaccggaacggtcccggcccgttcgggccgtcggccgttcgggtaaccg

SEQ ID NO: 373361 - DNA, 627 bp, Homo sapiens
  misc_feature: GZ8MTXP02INOZY.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcattctttaatagtttttggatgacctgggtccgccagggtccagggaagggctggagtgggtggccaaacataaagcaagatggaagtgaagaaatactatgtggactctgtgaaggccgatcaccatctccagagacaacgccaaagaacttactgtatctgacaaaatgaacagcctgagaggcgaggacaccggctctagtattactgtgcgaggtactaccctcctcgtgggccgggtcccgtacggtttcccgacggcagtgggaccgttcggtcgggggaccgaaacgggacccgacggtccacccggtcctcctcgacgcctaccaccgaacgggcccacgtccgtcccttcccccgtcgccctacccctccctaccgaaacgacgaccaccgtccgtcgggggaccaccgaacggccggcccgtcggggcctcggtcccgtcggtaacccgg

SEQ ID NO: 373362 - DNA, 606 bp, Homo sapiens
  misc_feature: GZ8MTXP02H8IJ9.15.87.H10.1.454.CMB.2.raw
  modified_base (300)..(300): a, c, t, g, unknown or other
  modified_base (383)..(383): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccagggaagggctgggagtgggtgccaaacataaagcaaagatggaagtgaagaaatactatggtggactctgtgaagggccgatcaccatccnccagagacaacgccaaagaacttactgtatctagacaaatgaaacagcctagagaggacgaggacaccggctctgtattacgngtgcgaggactacccgtcctcgtcggggcgtaccctacggtttcccacggtcagtcggacgtcgtcggggaccgaacgggaccgacggtccaccgtctcctcacgcctaccaccgacggcccacgtccggtccttcccccgcgtcccacccctacctacccgacgacgccgaccgtcggtcggggcacgaacggccggccgtcggacgtccgccgttcgaccg

SEQ ID NO: 373363 - DNA, 668 bp, Homo sapiens
  misc_feature: GZ8MTXP02JBZY3.15.87.H10.1.454.CMB.2.raw
  modified_base (369)..(369): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgactgggtccgcagggtccagggagggctggagtggtggccaacataaagcaagatggaagtgagaaatactatgtggactctgtgaaggccgatcaccatctccagagacaacgccaaagaacttactgtatctgacaaaatgaacagctagagaggcgaggacaccggctctgtattacngtgcgaggactaccctccgtacgtggggaccgggtcccgtacgggtttcccgtacggtcgtacggtcgggtaaccggtcggttacggggggaccgaaaccgggggaaccgtaaccgggtacccgtacccggtacccgttcccgtaccgtaccgtacccctaccccgaacccgaaaccggggcccctaacgtccgggttccccttcccccgtcggtcccacccccttccctaccgaaaccgacgaccacccgttcgtacgggggccacgaacgccgcccgtcgggctcgccgtgtaccgg

SEQ ID NO: 373364 - DNA, 604 bp, Homo sapiens
  misc_feature: GZ8MTXP02F19OR.15.87.H10.1.454.CMB.2.raw
  modified_base (294)..(294): a, c, t, g, unknown or other
  modified_base (299)..(299): a, c, t, g, unknown or other
  modified_base (318)..(318): a, c, t, g, unknown or other
  modified_base (376)..(376): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaaagatggaagtgaagaaatactatgtggactctgtgaaggccatcaccatcncaganacaacgccaaagacttacngtatctagacaaaatgaaacagcctggagaggcgaaggacacggctctgttattacgngtgcggagacttaccctcctgtacgggccgggtacctacggtttcccgtacggcgtagtcggacgtcgtcggggaccgaacgggacccgacggtccaccgtcctcctacacgccctaccaccgaaccggcccacgtccggtcccttccccgtcgcccaccctccctaccaaacgcgaccaccgtcgcggggcacgaacgccggccgtcggcgtcgccgtcggtaaccg

SEQ ID NO: 373365 - DNA, 574 bp, Homo sapiens
  misc_feature: GZ8MTXP02JB493.15.87.H10.1.454.CMB.2.raw
  modified_base (322)..(322): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaagggccgattcaccatctccagagacaacgccaaagaacttacngtatctgcaaaatgaacagcctgagaggcgaggacaccggctctgtattactgtgcgaggatacctcctcgtggcgggccagttcctacggcagtggacgtcgtcgggggccgaacgggaccacggtcaccgtctcctcagccctccaccaacgggcccagtccggtccttcccccgtcggccaccctccctccaacgacgccacctcgtcgggggcacgaacgccggcccgtcgggctcgccgtcggtacg

SEQ ID NO: 373366 - DNA, 578 bp, Homo sapiens
  misc_feature: GZ8MTXP02G0E59.15.87.H10.1.454.CMB.2.raw
  modified_base (373)..(373): a, c, t, g, unknown or other
  modified_base (391)..(391): a, c, t, g, unknown or other
  modified_base (460)..(460): a, c, t, g, unknown or other
  modified_base (464)..(464): a, c, t, g, unknown or other
  modified_base (544)..(544): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccagggtccagggaagggctggagtgggtggccaacataaagcaagatggaagtgagaaatctatgtggactctgtgaagggccgattcaccatctccagagacaacgccaaagaactactgtatctgacaaaatgaacagcctgagaggcgaaggacacggctctgtattacngtgcgaggatacctcctntgggccgggccctacggtttcctaacggcagtggacgtcgtgggaccgaagggaccacggtcaccgtcnctcngcctccacaacgggccactcgtccttccccctggcccaccccgtcctcccaaacgacgccacccgtcgacggggccaacncggccggcccgtcgggctcggccgtcggtaccgg

SEQ ID NO: 373367 - DNA, 608 bp, Homo sapiens
  misc_feature: GZ8MTXP02IX25E.15.87.H10.1.454.CMB.2.raw
  modified_base (233)..(233): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcatctttaatagtttttggatgacctgggtccgcagggtccagggagggctggagtgggtgccaanataaagcaagatggaagtgaagaaatactatgtggactctgtgaggcgatcacatctcagagacaacgaccaagaacttactgtatctgacaaataggggaacagcctagagaggcgaggacgaccggctctgtattactgtgcgaggactacctcctcgtcgggcgggtccgtacggtttccgtacggctagtcggacgtcgtcggggaccgaacgggaccgacggtccaccggtcctcctcacgccctaccaacccgaacgggcccacgtccggtcccttcccccgtcgccctacccctcctaccgaacgcgaccgaccgtcggtcgggggaccacgaacggcccggccgtcgggccgtcggccgtcggtacg

SEQ ID NO: 373368 - DNA, 660 bp, Homo sapiens
  misc_feature: GZ8MTXP02GSZWE.15.87.H10.1.454.CMB.2.raw
  modified_base (260)..(260): a, c, t, g, unknown or other
  modified_base (337)..(337): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggagtcgttggtccaacgtgggggtcctgagactctcctgtgcngcctctgattcattctttaattgtttgatgaccgtggtccgcgaggtcgaggggagggcgtggaggtggtcgacaanaagtaaagcgaaagagtaggaagtagaagtaaatatagtaggtggtacttcgtggtacggacgggccgtattaccacgtactcctacgaggaaacgaaccaaccgacctaaaagttaaaccttacttacgtaactacgtacgaaactaaaagtacggaaacacggtacccgaggaagggaccggacggaacggacgacggtacttcggttaagttacttacgtggaggtcggtaaacggtaccttcccgtccgttccggcgggggtaccggtaaccgttacggggttaccctggacgtacggttaccgggtacgtttccgggg

SEQ ID NO: 373369 - DNA, 552 bp, Homo sapiens
  misc_feature: GZ8MTXP02ILWB7.15.87.H10.1.454.CMB.2.raw
  modified_base (450)..(450): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcatctttaatagtttttggatgacctgggtccgccagggtccagggaggggctggagtgggtgccaacataaagcaagatggaaagtgaagaaatactatgtggactctggtgaagggcgattcacatctcagacgacaacgcaaagtaacttactgtatctagacaaaatgaaacngcctgaaggaggcgtaggacacggctctagtatacgtgtgcgaggtactacccgtcgtcgtgggccggcgtacggtttcccacgggcagtcgggactcgggg

SEQ ID NO: 373370 - DNA, 621 bp, Homo sapiens
  misc_feature: GZ8MTXP02HW7TL.15.87.H10.1.454.CMB.2.raw
  modified_base (236)..(236): a, c, t, g, unknown or other
  modified_base (303)..(303): a, c, t, g, unknown or other
  modified_base (326)..(326): a, c, t, g, unknown or other
  modified_base (344)..(344): a, c, t, g, unknown or other
  modified_base (362)..(362): a, c, t, g, unknown or other
  modified_base (377)..(377): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattctttaattagtttttggatgacctgggtccgcagggtccagggagggctggagtgggtgccaaanataaagcaaagatggaagtgaagaaatctatgtggactctgtgaacgggccattcaccatctcaganacaacgccaaagacttactgtanctagacaaaatgaaacancctagagaggcgaggacnccggctctgtattcngtgcgagactcctccgtgtcgggcgtccgtacgttccgacggctagtggacgtcggtcggggaccgaagggaccgacgtccaccgtctcctcgacgccctacccaccgaacggcccacgttccggtcccttcccccgtcggcccctaccccgttccacccgaaacgaccgaccgtacccgtcggccgggggaccaaccggccggcccggcccggttcgggccgtccgtacggttcggtaaccgg

SEQ ID NO: 373371 - DNA, 589 bp, Homo sapiens
  misc_feature: GZ8MTXP02H3GNG.15.87.H10.1.454.CMB.2.raw
  modified_base (356)..(356): a, c, t, g, unknown or other
  modified_base (476)..(476): a, c, t, g, unknown or other
  modified_base (538)..(538): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatctttaatagtttttggatgacctgggtccgccagggtccagggaaggggctggagtgggtggccaacataaagcaagatggaagtgagaaatctatgtggactctgtgaagggccattcaccatctcagagacaacgaccaagaacttactgtatctgcaaatgaacaagcctgagaggcgaggacnccggactctgtaattactgtgcgaggataccctctcgtgggcggacccgtacgtttccgtaccggcgagtggacgttcgtcgggggaccgaacgggaccgacggtcaccgtcgtacctcncgccctaccaccgaacggcccacgtccggtccttccccctgccacccctcctaccaacgacnccacctccgtacggggcacgaacgcgcccgtcggcgtcggtctacggtacg

SEQ ID NO: 373372 - DNA, 613 bp, Homo sapiens
  misc_feature: GZ8MTXP02FLMF9.15.87.H10.1.454.CMB.2.raw
  modified_base (236)..(236): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccagggtccagggaaggggctggagtgggtggccaanataaagcaaagatggaagtgaagaaatacatgtggactctgtgaaagccgattcaccatctcagagacaaacgccaaagaacttactgtaatctgacaaatagaaacagcctgagaggcgaaggacacggctacgtgtattacgtgtgcgaggacttacctcccgtcgtggggccgggcgtacggtttccgtacggctagtggtacgtcgcggggaccgaaacgggaccgaccggtcaccgtcctacctcgacgccctaccaaccgaacgggccctagtccggtcccctcccctcggccctaccccgtcctaccaacgacgacctaccgtcgtcggggcacgaacgccggcccgtcgggctcggccgtaggtaaccg

SEQ ID NO: 373373 - DNA, 603 bp, Homo sapiens
  misc_feature: GZ8MTXP02FN4P7.15.87.H10.1.454.CMB.2.raw
  modified_base (236)..(236): a, c, t, g, unknown or other
  modified_base (295)..(295): a, c, t, g, unknown or other
  modified_base (321)..(321): a, c, t, g, unknown or other
  modified_base (376)..(376): a, c, t, g, unknown or other
  modified_base (429)..(429): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgccagggtccagggaagggctggagtgggtggccaanataaagcaagatggaagtgagaaatactatgtggactctgtgaaggccattcaccatcnccagagacaacgccaaagaacttacngtatctgacaaaatgaaacagcctggagaggcgaggacaccggctctgtattacngtgcgagactacctcctctgggccggcctagtttcctacggcatggacgtcgnggggccaaagggccacggtccaccgtctcctcacgccctacccgaaccgaaccgggcccacgttccggtcccttccccccgtcggcccaacccctccctacccaaagacgaccacccgtcggtacgggggccaaccgaacggcccggcccgtcggggcctcggcctcggtaacg

SEQ ID NO: 373374 - DNA, 596 bp, Homo sapiens
  misc_feature: GZ8MTXP02FI91J.15.87.H10.1.454.CMB.2.raw
  modified_base (324)..(324): a, c, t, g, unknown or other
  modified_base (376)..(376): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggttccctgagactctcctgtgcagcctctggattcatcttttaatagtttttggatgacctgggtccgccagggtccagggaagggctggagtgggtggccaacataaagcaagatggaagtgaagaaatactatgtggactctgtgaagggccgattcaccatctccagagacaacgccaaagaacttacngtatctgcaaaatgaacagcctgagaggcgaggacaccggctctgtattacngtgcgaggatacctcctctgggcgggccacggtttcctacggcagtggacgtcgtgggggccaaacggggaccacggtcaccggtcctcctcacgccctacccacccgaaacgggcccacgtccggtccttccccctcggccacccctccctacccaaacgacgccacctccgtcgggggccacgaacgccggcccgtcgggcctcggcctcggtaaccg

SEQ ID NO: 373375 - DNA, 592 bp, Homo sapiens
  misc_feature: GZ8MTXP02GDDMC.15.87.H10.1.454.CMB.2.raw
  modified_base (230)..(230): a, c, t, g, unknown or other
  modified_base (286)..(286): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgcagggtccagggagggctggagtggtgcaanataaagcaagatggaagtgagaaatctatgtggactctgtgaaggcatcaccatcncagagacaacgcaaagacttactgtatctgacaaaatcgaaacagcctgagaggcgaaggacaccggctcgtagtattactgtgcgaggactaccctccgtgtgggccgggtccgtacggtttccgtacggcagtcggtacgtcgtcggggaccgaacgggaccgacggtcaccgtcctcctcacgcctaccaccgacggcccacgtccgtcctccccgtcgcccacccgttccaccgaacgacgacctaccgtccggtacggggcaaccgcggcccggccgtcgggcctcggtccgtcggtaacg

SEQ ID NO: 373376 - DNA, 616 bp, Homo sapiens
  misc_feature: GZ8MTXP02GKDPO.15.87.H10.1.454.CMB.2.raw
  modified_base (275)..(275): a, c, t, g, unknown or other
  modified_base (295)..(295): a, c, t, g, unknown or other
  modified_base (321)..(321): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaaagatggaaagtgaagaaatactatgtggactntgtgaaggccatcaccatcnccagagacaacgccaaagaacttacngtatctagacaaaatgaacagcctgagaggcgaaggacaccggctctgtattactgtgcgaggactacctcctcgtgggcgggtaccgtacggtttccgtacggcagtcggacgtcggtcggggaccgaaacggggaccgacggtccaccgtccgtcctcgacgccctcccaaccgaaccggcccacgtccggtcccttccccgtcgccctacccctccctacccaaacgacgaccaccgtccggcgggggccaccgaacggcccggcccgtcgggcctcgccgtcggtaaccgg

SEQ ID NO: 373377 - DNA, 615 bp, Homo sapiens
  misc_feature: GZ8MTXP02FZ9O8.15.87.H10.1.454.CMB.2.raw
  modified_base (303)..(303): a, c, t, g, unknown or other
tcagtctacgtagccacgaccggtgctcgatttagcagtactgcgttgggtttccttgttgctattttagaaggtgtccagtgtgaggtgcagttggtggagtctgggggaggcttggtccaacctgggggggtccctgagactctcctgtgcagcctctggattcatctttaatagtttttggatgacctgggtccgccagggtccagggaaggggctggagtgggtggccaacaataaagcaaagatggaagtgaagaaatactatgtggactctgtgaagggccatcaccatctccaganacaacgccaaagaacttactgtatctgacaaaatgaaacagcctggagaggcgaggacaccggctctgtattactgtgcgagactacctccgtcgtggggccggtccgtacggttccgtacggcgagtcggacgtcgtcgggggaccgaacggggaccacggtcacccggtcctcctcacgccctacccaaccgaaccggcccaacgtccggtcccttcccccgcgtcccacccctccctacccgaacgacgccaccgtcgtcgggggaccacgaacggcccggcccgtcgggccgtcgccgtcggtaaccg

SEQ ID NO: 373378 - DNA, 575 bp, Homo sapiens
  misc_feature: GZ8MTXP02JH391.15.87.H10.1.454.CMB.2.raw
  modified_base (333)..(333): a, c, t, g, unknown or other
  modified_base (391)..(391): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcatcttaatagttttgatgactggtccgcagggtccagggagggctggagtggtgccaanagtaaagcaagatggaagtgaagaaatactatgtgactctgtgaacgggcgattcacntctccagacacaacgacaaagtaacctactgtactctagacctaaagtgaaaccagccgtagaaggacggacgaggacgaacggcttgtacgttagtacctggtcgacgacggtactacccgtccgtcgtcggggccggtaaccgtcggtttacccgacggctaacggtcgggacgttccgggg

SEQ ID NO: 373379 - DNA, 639 bp, Homo sapiens
  misc_feature: GZ8MTXP02GOEXF.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcattctttaatagttttggatgacctgggtccgccgagggtccaggggaggggtctggaggtgggtggaccaacgataaagcaaagagtaggaaagtgaagaaatactagtgtaggacttcgtggtagaaggggtcccattccacctattccaccgagaacgaccaaaccgaccaaaagtacttactagtactctagacaaaatcgaaacacgtcctaggaggaaggaccgaggacctacggctcgtagttattacgtggtacggacggaacggtacctacccgtcccgtacggtcggggacccggggtaaccttacggggttttacccgacgggtacctaacggttcggggaaccgttccggggg

SEQ ID NO: 373380 - DNA, 654 bp, Homo sapiens
  misc_feature: GZ8MTXP02GY15G.15.87.H10.1.454.CMB.2.raw
  modified_base (593)..(593): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattctttaatagtttttggatgacctgggtccgccgagggtccaggggaaggggctgggaggtgggtcggaccaaacaataaagcaaagagtaggaagtgaaagaaattactatggtggactcgtggtggaagggccgattccaccatctccagacgacaacgccaaagaactttactgtatctgacaaaatgaaacagcctagaggaggcgaggacaccggtctctagtacttacgtgtgcgagtactacccgtccgtggtcgggccggtccgtacggtttcccgacggcaggtgggaccgtcggtcgggggaccaacggggacccacgggtccaccgtcctcctcgacgccctaccgaaccgaacgggcccacgttccggtacccctttccccgacgccctaacccctccgtaccaaggaccncccgtaaccgtcgggacggggccaacgcggcccggccgtcggctcggccgtacggtaaccg

SEQ ID NO: 373381 - DNA, 638 bp, Homo sapiens
  misc_feature: GZ8MTXP02H6ITD.15.87.H10.1.454.CMB.2.raw
  modified_base (322)..(322): a, c, t, g, unknown or other
  modified_base (357)..(357): a, c, t, g, unknown or other
  modified_base (374)..(374): a, c, t, g, unknown or other
  modified_base (389)..(389): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaaggggctggagtgggtggccaaacataaagcaagatggaagtgaagaaatactatgtggactctgtgaagggccattcaccatctccagagacaacgccaagaacttacngtatctgacaaatgaacagcctgagagcgaggacnccggctctgtattctgngcgaggactacctcnctgggcgggccacgtttccacggcagtggacgtcgtcggggaccgaaacggggacccgacggtccaccgtcctccctcgacgccctacccaacccgaaccgggccccacgttcccgggtaccctttccccccgtgggccccctaacccccgttccctacccgaaacgtacgacccgtaacccgttccggtaccgggggccaccgaacggcccggccccgttcggggccgtcggccgttacggtacccgg

SEQ ID NO: 373382 - DNA, 707 bp, Homo sapiens
  misc_feature: GZ8MTXP02GEHJE.15.87.H10.1.454.CMB.2.raw
  modified_base (275)..(275): a, c, t, g, unknown or other
  modified_base (293)..(293): a, c, t, g, unknown or other
  modified_base (298)..(298): a, c, t, g, unknown or other
  modified_base (320)..(320): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccagggtccagggaagggctggagtggggtggccaacataaagcaagatggaagtgaagaaatactatgtggactntgtgaaggcatcacatcncaganacaacgccaagaactactgtanctgacaaaatgaaacagcctaggagaggcgaggaccaccggtctctagtattactggtagcgagtactaccctccgtcgtcggggccgggtcccgtacggtttcccgtaccggacgtagtcgggtaccgttcggtacgggggaccggaaacggggacccgtaccggtaccgtaacccggttcctcccgttaccgaccgtaccccctaccccgaacccgtaaacccgggcccccgtaacggttcccggttcccccgttccccccgtaccgggtccccctaacccccgtccccgtacccgaaaccggaccgacccgacccgtccggtaccgggggccaccggaaccggcccggcccggtccggggcctcggtcccgtacggtaacccgg

SEQ ID NO: 373383 - DNA, 628 bp, Homo sapiens
  misc_feature: GZ8MTXP02G3ZWU.15.87.H10.1.454.CMB.2.raw
  modified_base (299)..(299): a, c, t, g, unknown or other
  modified_base (323)..(323): a, c, t, g, unknown or other
  modified_base (327)..(327): a, c, t, g, unknown or other
  modified_base (342)..(342): a, c, t, g, unknown or other
  modified_base (385)..(385): a, c, t, g, unknown or other
  modified_base (425)..(425): a, c, t, g, unknown or other
  modified_base (488)..(488): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcattctttaatagtttttggatgacctgggtccgccagggtccaggggaaggggctgggagtgggtggccaacataaagcaagataggaagtgaagaaatactatgtggactctgtgaaggccattcaccatcncagagacaacgccaagaacttacngtanctgacaaatgaaacngcctagaggaggcgaaggacaccggtctctgtacttacgtgcnggatactcctcgtcggcggcgtaccgttacgttccgacgnaggtcggcgtcggggtaccgggaacgaaccggggaccgccgtacctcccgtcctccacgcccnccctaccgaacgacccggacctcgtcccgtcccctcccggacgcccctaccctacctacgaaacgtccaaccgtccggtacgggccgggaccacggtccggcccggtcccggtcggccgtccgaccggttacgtaaacgg

SEQ ID NO: 373384 - DNA, 584 bp, Homo sapiens
  misc_feature: GZ8MTXP02F0C0N.15.87.H10.1.454.CMB.2.raw
  modified_base (266)..(266): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttcctgttgctattttagaaggtgtccagtgtgaggtgcaggttggtggagtcgtgggggaggcttggtccaaccgtgggggtccctgagactctcctgtgcagcctntggattcatcttaatagttttgatgactggtccgcgaggtcgagggagggctggagtgggtggccaaacataaagcaaagagtaggaaagtgaagaaatactatgtgactcgtgtagaaggcgattcacatctaccagacgacaacgacaaagtaactactagtatctagactaaaatcgaaacagacctaggaaggacggacgaaggacacgggtacttcgtagttacttactggtacgacggtacggtactacctccgtcgacggggtccggtaaccgtacggtttccgacgggctacgtcggggaacgttcgggg

SEQ ID NO: 373385 - DNA, 778 bp, Homo sapiens
  misc_feature: GZ8MTXP02GJPLS.15.87.H10.1.454.CMB.2.raw
  modified_base (162)..(162): a, c, t, g, unknown or other
  modified_base (202)..(202): a, c, t, g, unknown or other
  modified_base (282)..(282): a, c, t, g, unknown or other
  modified_base (302)..(302): a, c, t, g, unknown or other
  modified_base (409)..(409): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctntggattcattctttaatagtttttggatgacctgggtccncgagggtccaggggaagggctggagtgggtgaccaaacaataaagcaaagatggaaagtgaagaaatactatgtggactntggtgaaggccatcacatcncagacgaacaacgaccaaagtaacttactgtactctagaactaaaatgaaacagcctaggaaggacggacggaaaggtaccaccgggcttactagttaactttacgnggtacggcggaagtaacttacccttccgttacgtcgggggccgggtacccgttaacgggtttcccgtaaacgggactacggtagggtaccgtcgggtacgggggaaccgaaaacgggggaacccgtaccgggtaccgtaacccggttaccttcccgacgaaccgtaccccttaacccgaaccccggaaaacccgggtccccgtaacggtttaccccggttacccccgtttccccccgtccggtaccccctacccccttacccgtaaaccccgaaaggaacccgtacccgtaaccccgttcgggtacgggggacccaaccggaaccggtcccggacccgttcgggaccgtcggtccgtaccgggtaaacg

SEQ ID NO: 373386 - DNA, 671 bp, Homo sapiens
  misc_feature: GZ8MTXP02IKRUO.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggagcttggtccaaccgtggggggtccctgagactctcctgtgcagcctctggattcattctttaattagttttggatgaccgtcgggtccgccgagggtccgagggaaggggctggggaggtgggtggaccaaacgaataaagcaaaggtatggaaagtgaagtaaatacgtatggtggtacttcgtggtacggaaacggggtccctagttaccactaatcctaccgaggaaacgaaccaaacggacccaaaagttaaaccttacgtacgttaacttacacggaactaaaagttacgaaacaacggcctagggaacgggacgggacggaaccggacgtaccgggtcttacgtagttacgttacgtggtcgaccggtacggtaaactccccgttccgtcgacgggtccgggtaacctacggggtttaccacggctacggtcgggtaacgtccggg

SEQ ID NO: 373387 - DNA, 652 bp, Homo sapiens
  misc_feature: GZ8MTXP02FHVDL.15.87.H10.1.454.CMB.2.raw
  modified_base (323)..(323): a, c, t, g, unknown or other
  modified_base (380)..(380): a, c, t, g, unknown or other
tcagtctacgtagccacgaccggtgctcgatttagcagtactgcgttgggttttccgttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggagggctggagtggtgccaacataaagcaagattggaaagtgaagaaatactatgtggactgtgtgaaggcccgattcaccatctccagagacaacgccaaagaactttacngtatctgcaaaatgaaacagcctagagaggcgaggacaccggctcgtgtatttacgngtgcgagactaccctcctcgtcgggccgggtaccgtacgtttccgtacggctagtcggtacgtcgtacggggtaccgaacgggaccgaccggtccgaccgtcctaccctaccaccgccctaccccgaacccgaacccgggaccccgtacgtcccggttcccgttcccccgtcgaccccgtacccctaccctacccgaacgacgaccgacccgtccggtacggggaccaccgaaccggccggcccggtcggtccgtccggtccgtacggtacg

SEQ ID NO: 373388 - DNA, 713 bp, Homo sapiens
  misc_feature: GZ8MTXP02HRNDT.15.87.H10.1.454.CMB.2.raw
  modified_base (234)..(234): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcatctttaatagtttttggatgacctgggtccgcagggtccagggaagggctggagtgggtggccaanataaagcaagatggaagtgaagaaatactatgtggactctgtgaagggccattcaccatctccagagacaacgccaaagaacttactgtatctgacaaaatgaaacagcctagagaggcgaggacaccggctctgtattactgtgcggagacttacccgtccgttcgtcggggccgggtacccgtacggtttacccgtacggtaccgagttcgggaaccgttcggttaccgggggacccgaaaacgggggaccccgtaccgggtaccgtacccggttcctacccgttccgacgacccccttacccgaaaccccgaaccgggacccctaacggtcccggttccccgtttccccccgtcgggacccctacccccgttaccctaccccgaaaccggacgacccgaacccgttccggtacgggggaccaccgaaccggcccggccccgtcggggaccgtccggcccggttacggtaaacccgg

SEQ ID NO: 373389 - DNA, 625 bp, Homo sapiens
  misc_feature: GZ8MTXP02F8II2.15.87.H10.1.454.CMB.2.raw
  modified_base (295)..(295): a, c, t, g, unknown or other
  modified_base (383)..(383): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccaggggtccagggaagggctggagtgggtggccaacataaagcaaagatggaagtgaagaaatactatgtggactctgtgaaggccatcacatcncagagacaacgccaaagacttactgtaatctagacaaaatcgaaacagtcctaggaggaggcgaaggacaccggctcgtagtattacngtgcgagtactaccgtcctgtcgggccgggtccgtacggtttcccgtacggtctagtcggtaccgtcggtcggggaccgaacgggaccgacggtccaccgtcctcctcacgccctaccaccgaacggccctacgtccggtcccttacccccgcgccctacccctacctacccgaaagccgacctacccgtcggtcggggaccacgaacggcccggccgtcggcctcggtccgtcggtaaccg

SEQ ID NO: 373390 - DNA, 607 bp, Homo sapiens
  misc_feature: GZ8MTXP02HDXFR.15.87.H10.1.454.CMB.2.raw
  modified_base (379)..(379): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatcttttaatagtttttggatgacctgggtccgccagggtccagggaagggctggagtgggtggccaacataaagcaagatggaaagtgagaaatactaatgtggactctgtgaaggccattcaccatctccagagacaaacgccaaagacttactgtatctgcaaaatgaaacagcctagacgaggacgaggacaccggctctgtattacgngttcgcgaggactaccctcctcgtgggccggggccctacgggtttacctacggcagttgggacgttcgtacgggggccgaaacgggaccgacggtcaacccggtctcctcacgcctacccaccgaaacgggcccacgtccggtcttcccccgtgcctaccctcctccaagacgtcacctcgtcgggggcacgaaggccggcccgtcggggtctcgccgtacggtaccg

SEQ ID NO: 373391 - DNA, 679 bp, Homo sapiens
  misc_feature: GZ8MTXP02HUU0R.15.87.H10.1.454.CMB.2.raw
  modified_base (231)..(231): a, c, t, g, unknown or other
  modified_base (290)..(290): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggagggctggagtggtgccaanataaagcaagatggaagtgagaaatactatgtggactcgtgtgaaggccatcaccatcnccagagacaacgcaaagacttactgtatctagacaaatgaacagcctagagagcgaggacaccggctctgtattactggtgcgaagtactaccctccgttagcgggccgggtcccgtacgggtttccaccgggtctaacggtcggtaccggttcgtcgggggaccgtaaacgggggaccctacgggtcctacccggttctcccttcgacgtccctacccgaacccgtaacggggacccctacgttcccggtccccgttcccccgtaccgggtaccctaacccccgttcctacccgaaacggaccgaccttaccccgtccggtcgggggacccaaccgcgggccccgggcccgttcggggccgttccgggacccgtttacgggtaacccg

SEQ ID NO: 373392 - DNA, 649 bp, Homo sapiens
  misc_feature: GZ8MTXP02GYTCC.15.87.H10.1.454.CMB.2.raw
  modified_base (278)..(278): a, c, t, g, unknown or other
  modified_base (297)..(297): a, c, t, g, unknown or other
  modified_base (305)..(305): a, c, t, g, unknown or other
  modified_base (322)..(322): a, c, t, g, unknown or other
  modified_base (380)..(380): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgacctgggtccgccagggtccagggaagggctgggagtgggtgccaacataaagcaagatggaagtgaagaaatactatggtggactntggtagaaggccatcaccntctcaganacaacgcaaagacttcngtatcagacaaatgaacagcctagaggaggcgaggacaccggtctcgtagtacttcgngtgcgaagactaccctcgtcggtcgggccgggtcccgtacggtttccgtaccggctacggtcgggtaccggtcgggtaccgggggaccgtaaacggggacccgaccggtacccgtacccggtcctcccgtcctaccgccctacccgaacccgaaccgggcccacgtccgtccttcccccgcgccctaccccgtcccgtaccaagactcccgaccgtcggcggggccgaacgccggccggccggtcgggcctcggtccgtacggtaaccg

SEQ ID NO: 373393 - DNA, 710 bp, Homo sapiens
  misc_feature: GZ8MTXP02JIFE0.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagcttgggttttccttgttgcttattttagaaggtgtccagtgtgaggtgcagttggtggagtcggtgggggaggtcttggtccaaccgtcggggggtccctgagactctcctgtgcagcctcgtggtattcattactttaattaggtttttggattcgaccgtgggtcccgcgacgggtccgaggggaggggcgtggggaggtggggtacggaccaaacgtaagtaaaacggacgaaagagtagggaaaggtaggaaagtaaaattacgtagtaggttaggacttcgtgggtacgggaaacggggtaccgtacttccaacctactcccgtacccgaagaaccgaacgaaaccgaccgtaaaacgtaacttacctagttactacctagaactaaaagtacgaaaccacggtccgtagggaacggaacggacggaacgggaccaacgggtcttacggttagttaacgttcgtggtacggacggtaacggtactaacccgttcgtacggtcgggaccggtccgttaacggttcccgtacgggacctaggtcggacgttccggg

SEQ ID NO: 373394 - DNA, 648 bp, Homo sapiens
  misc_feature: GZ8MTXP02HW42Z.15.87.H10.1.454.CMB.2.raw
  modified_base (296)..(296): a, c, t, g, unknown or other
  modified_base (389)..(389): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccagggtccagggaaggggctggagtgggtgccaacataaagcaaagatggaagtgaagaaatactatgtggactctgtgaagggcgatcaccatcncagagacaacgccaaagaacttactagtatctagacaaaatgaaacagcctagaggaggacggaggacacggctcgtgtaattacgttgtcgngaagggtactacccgtccgttgtcggggccgggtccgtacggttttccgaaccggtcgagtcgggacgttcggtcgggggaccgaacggggacccgacgggtaccacccgttcctccctcacgccctacccgaaccgaaacgggccccacgttcccggtccctttcccccgtcggtcccctacccctccctaccgaacgaacgccgtaacccgtcgtcggggccacgcgcccggccgtcgggctccgccgtcggtaccg

SEQ ID NO: 373395 - DNA, 569 bp, Homo sapiens
  misc_feature: GZ8MTXP02GOLAC.15.87.H10.1.454.CMB.2.raw
  modified_base (340)..(340): a, c, t, g, unknown or other
  modified_base (452)..(452): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcatctttaatagttttggatgacctgggtccgccagggtccagggaggggctggagtgggtgccaanataaagcaagatggaagtgaagaaatactatgtggactctgtgaaagggccgattccacatctccagacgacaacgccaaagtaacttactgtaatctgacaaaatgaaacngacctgagaggacgaggacacggcttctagtattactggtgacgaggactacctcctacgtcgggccgggtccgtaacgggttttcccgaccgggcacgttcggggtacgtaccggg

SEQ ID NO: 373396 - DNA, 727 bp, Homo sapiens
  misc_feature: GZ8MTXP02JLRTL.15.87.H10.1.454.CMB.2.raw
  modified_base (237)..(237): a, c, t, g, unknown or other
  modified_base (299)..(299): a, c, t, g, unknown or other
  modified_base (382)..(382): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtcccggagactctcctgtgcagcctctggattcatctttaatagtttttggatgacctgggtccgccagggtccaggggaagggctggagtgggtggccaanataaagcaagatggaagtgaagaaatactatgtggactgtgtagaagggccgtattcaaccntctccagacgacaacgaccaagtaactttactgtaatctagactaaaatgaaacagccctaggagaggcgaggacacggcctntgtatactgtgacgaggactaccctcgtcgtgggccgggtacctacgggtttcccgtacggctagtcgggtacgtcggtacgggggacccgaaacggggaccctaccgggtacctaacccgtccgtacccgtcgaaccggtcccctaccccgaacccggaacccggggtaccccctacggttccccggttcccccgttacccccgtccgggtacccctacccccgttaccccctaccggaaacgaccgacccgtaacccgttccgggtccgggggaccaccggaccggcccgggtccccggtacggggtccgtccggtacccggtttacggaccggttaaaccgg

SEQ ID NO: 373397 - DNA, 597 bp, Homo sapiens
  misc_feature: GZ8MTXP02HUIV6.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaggggctggagtgggtggccaaacataaagcaaagatgggaagtgagaaatactatgtggactctgtgaagggccgattcacccatctccagagacaaacgccaagaactactgtatctgcaaaatgaacagccctgagaggcgaggacacggctctgtattactggttagcgagggattaccctcctcgtgggacgggcccgacggtttccgtacggtcaattgggacgttcgtcgggggccaacggggacccacggtccacccggttcctccctcacgccctccacccaacggggccccatccggtcttccccctggccacccctcctaccacgacgcacctcgtcggggcacgaagccggccgtcggcgtcgccgtggtaccg

SEQ ID NO: 373398 - DNA, 612 bp, Homo sapiens
  misc_feature: GZ8MTXP02F2KUI.15.87.H10.1.454.CMB.2.raw
  modified_base (319)..(319): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatcttttaatagtttttggatgacctgggtccgccagggtccagggaagggctggagtgggtggccaacataaagcaagatggaagtgagaaatactatgtggactctgtgaaggccgattcacatctccagagacaacgccaagaacttacngtatctgacaaaatgaaacagcctaggagaggcgaaggacacggctctgtattactgtgcgagactacctcctgtggggccgggtacctacggtttcccgtacggcagtcggacgtcgtcggggaccgaacggggaccacggtccaccgtcctcctcgacgccctacccgaaccgaaccggcccaacgtccggtcccttcccccgtcggcccaccccttacccgtcccaaacgcgaccaccgtccgtcgggggaccacgaacggccggcccgtcgggcgtcgccgtggtaccg

SEQ ID NO: 373399 - DNA, 613 bp, Homo sapiens
  misc_feature: GZ8MTXP02G2NPU.15.87.H10.1.454.CMB.2.raw
  modified_base (462)..(462): a, c, t, g, unknown or other
  modified_base (486)..(486): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcattctttaattagttttggatgaccgtgggtccgccgagggtccgaggggaaggggcgtgggaggtggggtcggaccaaacgaagtaaaagcaaagagtaggaaagtgaagaaatactatggtaggactcgtgtaggaagggtccattccacctatcctaccagacgacaacgccaaagtaacttacngtactctagactaaagtcgaaacngtccaggaggaggacgagacgacggctcgtagtacttacgtggtcgacggacggtacttacccgtccgtcggtcggggccgggtccgtacggtttccccgacggactacggtcgggacgtaccgggg

SEQ ID NO: 373400 - DNA, 623 bp, Homo sapiens
  misc_feature: GZ8MTXP02IVAHX.15.87.H10.1.454.CMB.2.raw
  modified_base (295)..(295): a, c, t, g, unknown or other
  modified_base (320)..(320): a, c, t, g, unknown or other
  modified_base (374)..(374): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgccagggtccagggaaggggctggagtgggtggccaacataaagcaagatggaagtgagaaatactatgtggactctgtgaaggccattcacatcnccagagacaacgccaaagacttacngtatctgacaaatgaacagcctagaggagcgaaggacaccggctctgtattacngtgcgagactacccgtcctcgcgggccgggtaccgtacggtttcccgtacggcagtcggtacgtcggtcgggggaccgaacggggaccgacggtccgaccgtcctcctacgacgccctccgacccgaacgggcccacgttcccggtccttcccccgtcggaccctacccctaccctaccgaacgacggacctaccgtcggtacgggggaccacgaacggccggccgtcgggctcggtccgtcggtaacg

SEQ ID NO: 373401 - DNA, 627 bp, Homo sapiens
  misc_feature: GZ8MTXP02IAUXC.15.87.H10.1.454.CMB.2.raw
  modified_base (568)..(568): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaattagtttttggatgacctgggtccgccagggtccagggaagggctggagtgggtgccaacataaagcaaagataggaagtgaagaaatactatggtggactctggtgaagggcctattccaccatctccagagacaacgcaaagaacttactgtatctgacaaaatgaaacagcctagagaggcgaaggacaccggtctactgtattactggtgcgaggtactaccctcctcgtggggccggccgtacggtttcccacggtcagtcggaccgttcggcggggaccgaaacgggaccgacggtccaccgtcctcctcacgccctaccgaaccgacgggaccctacgtcccggtcccttcccccgcgacccaccccgtccctaccaacgacnccaccgtcgtcggggaccacgaaccggccggcccgtcggcctcggtccgtcggtaaccg

SEQ ID NO: 373402 - DNA, 685 bp, Homo sapiens
  misc_feature: GZ8MTXP02G9AH3.15.87.H10.1.454.CMB.2.raw
tcagtctacgtagccacgaccggtgctcgatttagcagtactgcgttgggttttccttgttgctattttagaaggtgtccagtgtgaggtgcagttggtggagtcgtgggggaggcttggtccaaccgtggggggtccctgagactctcctgtgcagcctctggattcattcttttaattagtttttggatgacctgggtccgcgagggtccaggggagggctgggagtgggtgaccaaacaataaagcaaagagtaggaaagtgaagaaatactatggtggactcgtggtaggaagggccgattccacctatcctaccaagacaaccaaccgaccaaagtaactttactagttatctagacaaaatgaaacagtcctaggaggaggcgaaggtacaccggcttcgttagtattacgtgtacggcgtaaggtacttacccgtccgtgtcggggccggtacccgttacggtttacccgtacggtacgtagtcggtacgtccggtacggggaccggaaacggggaccgaccggtacccgtacccgtcctccgtccgtacgaccctacccgaaccgaaccggacccgacgtccgttccccgtccccgttcgccctacccctcccaccgtacgacgaccgaccgttccgacggggcacgcggccgccgtcggcgtcgtccgtcgtaacg

SEQ ID NO: 373403 - DNA, 596 bp, Homo sapiens
  misc_feature: GZ8MTXP02FJQO9.15.87.H10.1.454.CMB.2.raw
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatcttttaatagttttttggatgacctgggtccgccagggtccagggaagggctggagtggtggccaacataaagcaagatggaagtgagaaatactatgtggactctgtgaagggccattcaccatctccagagaaaaacgccaaagaactttactgtatctgcaaaatgaacagcctgagaggcgaggcacggcctctgtattactgtgcgaggataccctctcgtggcggggccaggtttccctacggcatggacgtcgtggggccaaaggggacccacggtccacccgtctccctcacgccctcccaacccaaggggccccactccgggttccttccccccctggccacccctccctacccaaagacgccacccgtcgtcgggggcacgacggccggcccgtcggggctgcccgtggtcaaacgg

SEQ ID NO: 373404 - DNA, 687 bp, Homo sapiens
  misc_feature: GZ8MTXP02HMCEB.15.87.H10.1.454.CMB.2.raw
  modified_base (304)..(304): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggagcttggtccaaccgtgggggtccctgagactctcctgtgcagcctctggattcatctttaattgttttggatcgacctgggtccncgaggtccgagggaggggctgggaggtgggtcgaccaacaagtaaagcaaagagtagggaaagtagaacgtaaaatacgttatcggtaggaccttgtgggtagggaaacggggtccgtacttaccaacccaattcccgacccgaagaaccgaaacccaacgtaacccaaaagtaaacctttaccgtagttaactaccgttagaactaaaagtacgaaaccgaaacgttcccgaggaaacgggacgggaccggaaagggtaccccgaacgggtcttacgttagtttaaaacttcgtggtacgacggtaaacggtacttaccctccgtcgtccgggccggtaacccgtaggtttacccgacggcgtaacggtcgggtactcgggg

SEQ ID NO: 373405 - DNA, 638 bp, Homo sapiens
  misc_feature: GZ8MTXP02FE69S.15.87.H10.1.454.CMB.2.raw
  modified_base (235)..(235): a, c, t, g, unknown or other
  modified_base (321)..(321): a, c, t, g, unknown or other
  modified_base (341)..(341): a, c, t, g, unknown or other
  modified_base (350)..(350): a, c, t, g, unknown or other
  modified_base (356)..(356): a, c, t, g, unknown or other
  modified_base (374)..(374): a, c, t, g, unknown or other
tcagtctacgtagccacgaccggtgctcgatttagcagtactgcgttgggtttccttgttgctattttagaaggtgtccagtgtgaggtgcagttggtggagtctggggggaggcttggtccaacctgggggggtccctgagactctcctgtgcagcctctggattcatcttttaatagtttttggatgacctgggtccgccagggtccaggggaagggctggagtggtgccaanataaagcaagatggaagtgagaaatactatgtggactctgtgaagggccattcaccatctccagagacaacgccaaagactttacngtatctgacaaaatgaaacngcagagagngagacnccggctctgtacttacgngtgcgagtactaccctccgtgtacggggccggtacgtacgtttccgtacggtacgagtcggacgtcggtacggggaccgaacgggaccgacggtccgtaccgtcctccgtcgaccgaccctacccgaaccgaaccggacccgtacgtcccggttccctcccccgtaccgtaccctacccctcccgtaccgacgacgaccgtaccgtccggtacggggaccacgaacggccggtacccgtcgggtccgtcggaccgtacggtacg

SEQ ID NO: 373406 - DNA, 682 bp, Homo sapiens
  misc_feature: GZ8MTXP02HFUA4.15.87.H10.1.454.CMB.2.raw
  modified_base (301)..(301): a, c, t, g, unknown or other
  modified_base (306)..(306): a, c, t, g, unknown or other
  modified_base (325)..(325): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgacctgggtccgccagggtccagggaagggctggaggtgggtggccaaacataaagcaaagagtggaaagtgaagaaatctatgtggactctgtgaaggccattcacatcncaganacaacgccaagtaacttcngtatctgacaaatgaacagcctgaggaggcgaggacacccggctcgtagttacttacgtggtcggcgtaaggacttaccctccgttcgtcggggccgggtcccgtacgtttccgtacggctacggtcggtacgtcggtacggggaccgaaacgggtaccgacggtcctaccgtcctcctcgtacgccctaccgacccgaaccggcccctacgtcccggttcccttcccccgtcggtaccctacccccgtccctacccgaaacggaccgacccgtacccgtccgggtaccgggggaccaacccggcggtcccggggtccccgttcggggaccgtccggtacccggtcggtaaacccgg

SEQ ID NO: 373407 - DNA, 720 bp, Homo sapiens
  misc_feature: GZ8MTXP02GKW31.15.87.H10.1.454.CMB.2.raw
  modified_base (279)..(279): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattctttaatagtttttggatgacctgggtccgccagggtccaggggaagggctggagtgggtggccaaacataaagcaaagatggaagtgaagaaatactatgtggactntgtgaaggccatcaccatctccagagacaacgccaaagaacttactgtatctagacaaaatgaaacagcctaggagaggcgaaggtacaccggctctagtattactggtcgcggtaaggacttaccctcccgtcgtcgggggcccgggtacccgtacgggtttacccgtaaccgggtcgtaaggtcggggtaccggttccggtacgggggacccgaaacgggggtaacccgaccgggtacccgaaccccggttccctacccttccgaccgtcccctacccccgaacccgaaacccggggtcccctaccgttccccgggttcccctttccccccggtcggtccccctaacccccttcccgtacccaaacggaccgaccctacccgtcggtacgggggccaccgaacggcccggcccgtcgggaccgtcggccgtcggtaccg

SEQ ID NO: 373408 - DNA, 743 bp, Homo sapiens
  misc_feature: GZ8MTXP02JRDU9.15.87.H10.1.454.CMB.2.raw
  modified_base (300)..(300): a, c, t, g, unknown or other
  modified_base (328)..(328): a, c, t, g, unknown or other
  modified_base (365)..(365): a, c, t, g, unknown or other
  modified_base (372)..(372): a, c, t, g, unknown or other
  modified_base (382)..(382): a, c, t, g, unknown or other
tcagtctacgtagccacgaccggtgctcgatttagcagtactgcgttgggttttccttgttgcctattttagaaggtgtccagtgtgaggtgcagttggtggagtctggggggaggcttggtccaacctgggggggtccctgagactctcctgtgcagcctctggattcattctttaatagtttttggatgacctgggtccgccgagggtccaggggaagggctgggagtgggtgaccaacataaagcaaagatggaagtgaagaaatactatgtggactctgtgaaggccatcacatcnccagacacaacgaccaaagaacttactntatctagacaaatgaacagcctaggagaggcgagacnccggctntgtatactgngcgagtacttccctccgtcggtcggggccgggtaccgtacgggtttcccgacggcgtacggtcgggacgtcggtccgggggaaccggaacggggaccccgtaccgggtacctaccccggtcccttcccgtaccgacccgtaccccgtaccccgaacccggaacccggggtcccctaaccggttccccggttccccttccccccggtccgggtccccctaaccccccgttacccgtaaccccggaaacggacccgtaccccgtacccgggttaccggggtaccgggggacccaaacccggcggggtcccccggtccccggggtacgggtccccggtccggtcccggttacgggtaaacccgg

SEQ ID NO: 373409 - DNA, 653 bp, Homo sapiens
  misc_feature: GZ8MTXP02FOS67.15.87.H10.1.454.CMB.2.raw
  modified_base (267)..(267): a, c, t, g, unknown or other
  modified_base (498)..(498): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggagcttggtccaaccgtggggggtccctgagactctcctgtgcagcctcnggattcattctttaatagtttttggatgacctggtccgcagggtccgaggggaggggctgggagtggggtcggaccaaacgagtaaaagcgaaagataggaaaggtagaacgaaaatactagtggtaggaaccttcgtggtaggaagggcccgtaattccaacccatccctaccaagagaacccaaacgtaccaaagaaccttactgtaactctagactaaaagtgaaacncgtaccgtaggaacgggacgggacggaaaggtaccgacggtccttacgtagttaacgtttacgtggtacggacggtaacggtaccttacccgttccgtcggtaccgggcccggtaaccggtacggttacccgacggctacggcggggtacgtcgg

SEQ ID NO: 373410 - DNA, 607 bp, Homo sapiens
  misc_feature: GZ8MTXP02JRVCH.15.87.H10.1.454.CMB.2.raw
  modified_base (302)..(302): a, c, t, g, unknown or other
  modified_base (307)..(307): a, c, t, g, unknown or other
  modified_base (330)..(330): a, c, t, g, unknown or other
  modified_base (372)..(372): a, c, t, g, unknown or other
  modified_base (379)..(379): a, c, t, g, unknown or other
  modified_base (395)..(395): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccgaaccgtggggggtccctgagactctcctgtgcagcctctggattcatctttaatagtttttggatgacctgggtccgccagggtccaggggaagggctgggagtgggtcgccaacataaagcaagatggaagtgaagaaatactatgtggactcgtgtgaagggccattccaccatcncaganacaacgccaagaacttactgtanctgacaaaatgaaacagcctggagaggcgaggacaccggctntgtatcngtgcgagactccctcngtgggcgggtcacggttccacggcagtggacgtcgtcggggaccgaacgggaccgacggtacgacccggtcctcccgtcacgccctaccaaccgaaccggcccctacgtcccggtccccttcccccgtcggcccaccccttacccgtacccaacgacgccacccgtcgtcggggacaccgaacgccggcccgtggctcggcccgtggtaccg

SEQ ID NO: 373411 - DNA, 634 bp, Homo sapiens
  misc_feature: GZ8MTXP02I1LIZ.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagcttgggttttccttgttgcttattttagaaggtgtccagtgtgaggtgcagttggtggagtcgtgggggagtcttggtccaacgtgggggtccctgagactctcctgtgcagcctctggattctattctttaattagttttgatcgaccgtggtccgcgaggtccgagggagggctggagtggtgaccaacataaagcaagagtaggaagtgaagtaaatactatgtgacttcgtggtagaacggggcctattccaacgtatctaccagacgacaaacgaccaaagtaacttacgtagtaactcgtagactaaagtcgaaacacgtaccgtaggacgggaacggaccgaaaggaccgtacggacttcgtagttattaccgttggacgacggtacgtaaacgttaccccgttccgtacggtccgggtccggtaaccgttaccgggttttacccgacggtcgtaacggttcggaccggtttcggg

SEQ ID NO: 373412 - DNA, 677 bp, Homo sapiens
  misc_feature: GZ8MTXP02F8FFQ.15.87.H10.1.454.CMB.2.raw
  modified_base (199)..(199): a, c, t, g, unknown or other
  modified_base (227)..(227): a, c, t, g, unknown or other
  modified_base (233)..(233): a, c, t, g, unknown or other
  modified_base (296)..(296): a, c, t, g, unknown or other
  modified_base (301)..(301): a, c, t, g, unknown or other
  modified_base (316)..(316): a, c, t, g, unknown or other
  modified_base (323)..(323): a, c, t, g, unknown or other
  modified_base (332)..(332): a, c, t, g, unknown or other
  modified_base (370)..(370): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagttttggatgacctgggtccnccagggtccagggagggctggagtgggngccaanataaagcaaagatggaaagtgaagtaaatactagtgtggactcgtggtgaaggcatcacatcncaganacacgcaagactatntatcaanaaatgaacngctagagaggcgagtacgacggcctctgtattactggngcgagactaccctccgtgcgggcggccgttacggtttccgacggcagtaggtacgtcggtacggggaccgtaaacggggacctaccgggtaccgaacccgttcctaccctcgtaccgtccccgtaccccgaaacccggaaacggggacccccctaggtcccgttcccccgttccccccgtccggtaccccctacccccttacctaacccgaacggtaaccgccctaacccggtccgggtaccgggggaccaaccggcgggcccggtccccgttcggggcctcggaccgttcgggtaccgtaaaccgg

SEQ ID NO: 373413 - DNA, 616 bp, Homo sapiens
  misc_feature: GZ8MTXP02FT1JR.15.87.H10.1.454.CMB.2.raw
  modified_base (231)..(231): a, c, t, g, unknown or other
  modified_base (295)..(295): a, c, t, g, unknown or other
  modified_base (314)..(314): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctggtccgcagggtccagggagggctggagtggtgccaanataaagcaagatggaatgaagaaatactatgtggactctgtgaaggccgatcacatctccaganacaacgcaaagaacttacngtatctagacaaaatgaaacagcctagagaggcgaaggacaccgctcgtgtattacgtgtagcgaggactacctcctcgtgggccgggtacctacggtttccgtacggctaagtcggacggttcgtcgggggaccgaaacggggacccgacgggtccaacccggttcctcctacacgccctacccgaaccgaaccgggccctacgtcccggttcccttcccccgtcggcccctaaccccgtcctaccgaaagtcgaccaccgtcgacggggcaacgcggcgccgtcggctcgccgtcgtacg

SEQ ID NO: 373414 - DNA, 605 bp, Homo sapiens
  misc_feature: GZ8MTXP02IOCS8.15.87.H10.1.454.CMB.2.raw
  modified_base (293)..(293): a, c, t, g, unknown or other
  modified_base (337)..(337): a, c, t, g, unknown or other
  modified_base (489)..(489): a, c, t, g, unknown or other
  modified_base (530)..(530): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattctttaatagtttttggatgacctgggtccgcagggtccagggagggctgggagtgggtggccaacataaagcaaagatggaagtgaagaaatctatgtggactctgtgaaggcatcacatcncagagacaacgccaagaacttactgtatctagacaaatgaaacngcctagaggaggcgaggacacggctcgtagttattacgtggtacgcgggaagtacttacccgtcctacgtggggccggtaccgtacgtttccgtacggcagtggtacgtcgtcggggaccgaacgggaccgacgtaccgaccgttctcctcnccgtacccaccacccgacggccgactccggtccttccccgngcccaccctacctacacgacgccaccgtcgtcgggaccacgaacggccgccgtcggcgtcgtaccgtcgtaaccg

SEQ ID NO: 373415 - DNA, 711 bp, Homo sapiens
  misc_feature: GZ8MTXP02GPZDY.15.87.H10.1.454.CMB.2.raw
  modified_base (272)..(272): a, c, t, g, unknown or other
  modified_base (291)..(291): a, c, t, g, unknown or other
  modified_base (314)..(314): a, c, t, g, unknown or other
  modified_base (350)..(350): a, c, t, g, unknown or other
  modified_base (365)..(365): a, c, t, g, unknown or other
  modified_base (381)..(381): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctggagtgggtggccaacataaagcaagatggaagtgaagaaatctatgtggactntgtgaaggccatcacatcncagagacaacgcaagaacttacngtatctgacaaatgaacagcctgagaggcgaggacncggctctgtattacngtgcgagactacctcncgtggcggctacgttccacggcagtcggacgtcgtcgggggaccgaaacggggaccgaccggtcaaccccggttcctacccgtaccgacgccccttacccgaacccgaaaccgggggtcccctaacggttcccgggttcccctttcccccccgtacgggtaccccctaaccccccggttaccccttaccccgaaaaccggttaaccggtacccgaaaccccggtttcccgggtaccggggggtacccaaacccgggtaaccgggaccccggggcccccggttacgggggaccccgtttacgggcccccggttacggggtttaaaccccgg

SEQ ID NO: 373416 - DNA, 703 bp, Homo sapiens
  misc_feature: GZ8MTXP02FQY48.15.87.H10.1.454.CMB.2.raw
  modified_base (287)..(287): a, c, t, g, unknown or other
  modified_base (304)..(304): a, c, t, g, unknown or other
  modified_base (394)..(394): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgacctgggtccgccgaggggtccaggggaaggggctgggaggtgggtggccaacataaagcaagatggaagtgaagaaatactatggtggactctgnggaaggccatcacatcncagagacaacgaccaagaacttactgtatctagacaaaatgaacagcctaggagacggcggaacggacaccggcttcgtagtacttacgnggtgccggtaagacttacccttccgtgtcggggccgggtccgttacgggtttccgtacggcagtcgggacgtacggtcgggggacccgaaacggggacccgtaccggtccgtaccccgttcctcccgtaccgacgtacccccgtaccaaccccgaaccggggaccctacggttccccggttaccccttccccccggtcggtaccccctacccccgtaccctacccgaacgtaccgcctaacccgttcggcgggggaccacggaaccggtccggacccggtcggggtcgtcggtcccgtcgggtaaaccg

SEQ ID NO: 373417 - DNA, 594 bp, Homo sapiens
  misc_feature: GZ8MTXP02FYKI3.15.87.H10.1.454.CMB.2.raw
  modified_base (200)..(200): a, c, t, g, unknown or other
  modified_base (318)..(318): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccnccagggtccagggagggctggagtggtgccaacataaagcaagatggaagtgaagaaatactatgtggactctgtgaagggccattcaccatctcagagacaacgccaaagacttacngtatctaacaaatgaacagcctgagaggcgagacacggcctctgtattactgtgacgaggactaccctcctcgtggggcgggtcctaggtttccgtacgctagtggacgtcgtcggggaccgaacgggaccgacggtccgaccgtctcctcacgccctccgaccgaacggcccacgtccggtcccttcccccgcggcctacccctccctaccaacgacgcaccgtcgtcgggggcacgacgccggcccgtcggctcgccgtacggtacgtaaacgg

SEQ ID NO: 373418 - DNA, 646 bp, Homo sapiens
  misc_feature: GZ8MTXP02FMCKU.15.87.H10.1.454.CMB.2.raw
  modified_base (235)..(235): a, c, t, g, unknown or other
  modified_base (242)..(242): a, c, t, g, unknown or other
  modified_base (267)..(267): a, c, t, g, unknown or other
  modified_base (321)..(321): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatctttaatagtttttggatgacctgggtccgccagggtccagggaagggctggagtgggtggccaanataaagnaagatggaagtgagaaatactatgnggactctgtgaagggccgattcaccatctccagacgacaacgcaagaacttacngtatctgcaaaatgaacagcctgagaggcgagacacgactctgtattactgtgcgaggataccctcctcgtagggccgggcctaacgggtttccctaaccggctaagtcgggaccggttcgtcggggggaccgaaacgggggacccacgggtccgaacccggttccgtccccttacgaacgtcccgtacccaaaccgaaacggggcccccaagttccggtccctttcccccgacggtcccaccccgtcccctacgaaacgacgaccacccgtcggtcggggaccaaccgcggccggcccgtgggccttcggcccgtcggtaaccg

SEQ ID NO: 373419 - DNA, 628 bp, Homo sapiens
  misc_feature: GZ8MTXP02HHOR3.15.87.H10.1.454.CMB.2.raw
  modified_base (381)..(381): a, c, t, g, unknown or other
  modified_base (391)..(391): a, c, t, g, unknown or other
  modified_base (565)..(565): a, c, t, g, unknown or other
  modified_base (580)..(580): a, c, t, g, unknown or other
  modified_base (615)..(615): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtcccaacctgggggggtccctgagactctcctgtgcagcctctggattcatctttaatagtttttggatgacctgggtccgccagggtccagggaagggctgggagtggggtggccaaacataaagcaaagatggaagtgaagaaatactatgtggactctgtgaacgggccgattccacatctccagagaacaacgcaaagtaacttactgtaatctgacaaaatcgaaacacgcctagagaggcgaaggacaccggctcngtaacttcgngtgcgagactacctcctgcgggcgggtcccgtacggttttcccgaacggctaagtcgggaccgtcggtacgggggacccgaaacggggtaccaccgggttccaacccggtcctaccctcgaccgtccctcccgaaccgacgggaccctacgtccggtcccttccccgtgacccncccctccaccagacnccgtaccgtcggcgggcacgcggtccgccgcggcncgtcgcgtaaccg

SEQ ID NO: 373420 - DNA, 591 bp, Homo sapiens
  misc_feature: GZ8MTXP02I3CJ1.15.87.H10.1.454.CMB.2.raw
  modified_base (339)..(339): a, c, t, g, unknown or other
  modified_base (440)..(440): a, c, t, g, unknown or other
  modified_base (453)..(453): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggagcttggtccaaccgtgggggtccctgagactctcctgtgcagcctctggattcatctttaatagttttgatgacctgggtccgcgagggtccgaggggaggggctggagtgggtgccaanagtaaagcaagatggaagtgaagaaatactatgtggacttctggtagaagggccgattccacatcctcagacacaacgccaaagtaacttactgtatctanacaaatcgaaacncgcctaggaggacggacgaggaccgtacgggacttcgtagtactttacgtggtcgacggacggtacctacccgttcctacggtcgggccgggtccttaacgggtttcccaacgggctacggtcggtaaccggttcggg

SEQ ID NO: 373421 - DNA, 703 bp, Homo sapiens
  misc_feature: GZ8MTXP02JXMAT.15.87.H10.1.454.CMB.2.raw
  modified_base (359)..(359): a, c, t, g, unknown or other
  modified_base (401)..(401): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgacctgggtccgccgagggtccaggggaagggctgggagtggggtcggaccaaacaataaagcaaagagtaggaaagtgaagaaatactagtgtggactcgtgtaggaagggccattccaccatcctccagacacaacgcaagaacttctgtatctgacaaatgaaacngcctagaggaggacgaggacaccggtctcgtagtacttacgnggtcgcgagactaccgtcctcgtcggggccggtacgtacggtttacccgtacggctaggtacggtaccgtcggtcgggggaccgaaacggggaccgaccggtccaccggttcctacctcgaaccgccctacccgaaccgaaccgggacccctcggttccccggtcccgttccccccgtacggaccccctaccccgtccccgtaccgaaaggccccgtaccgtaccccgttacggggccgggggacccacggaaccgggtcccggtcccggtcggggacctccggtccggtacggtaacccgg

SEQ ID NO: 373422 - DNA, 718 bp, Homo sapiens
  misc_feature: GZ8MTXP02GI3AE.15.87.H10.1.454.CMB.2.raw
  modified_base (292)..(292): a, c, t, g, unknown or other
  modified_base (371)..(371): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaaccgtggggggtccctgagactctcctgtgcagcctctggattcattctttaattagtttttggatcgaccgtgggtcccgccgagggtccgaaggggaaggggctgggaggtgggtcggaccaaacaataaagcaaagatggaagtgaagaaatactagtgtggactntggtaggaagggcctatccaccatctccagagacaacgaccaaagtaacctttactgtatctagaacaaaatcgaaacncgcctaggaggaggacgaggacacccggcttcgttgttacttacgtggtacggcggtacgtaacttaccctccgtcggtcggggccgggtcccgttacgggtttcccgtacggcgtaggtcggaccggttcggtcgggggacccgaacggggacccgacggtcccgacccgttccgtcccgtccgaaccgccctacccggaccgaacccgggtccctacgttcccggtccccttcccccgtccgaccccgtaccccctacctaccgaaaccgcgtaccccgtaccgttccggggacggcccaacgccggccccggtaccggtcggccgtccggccgtacggtaaccg

SEQ ID NO: 373423 - DNA, 772 bp, Homo sapiens
  misc_feature: GZ8MTXP02I85FO.15.87.H10.1.454.CMB.2.raw
  modified_base (295)..(295): a, c, t, g, unknown or other
  modified_base (320)..(320): a, c, t, g, unknown or other
  modified_base (373)..(373): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgcagggtccaggggaagggctggagtgggtggccaacataaagcaagatggaagtgaagaaatactatgtggactctgtgaagggccattcaccatcnccagagacaacgccaagaacttacngtatctgacaaatgaacagcctagagaggcgaaggacacggctctgtattacnggtgcggaggtaacttacccgtccttcgtggggccggggtcccgtaacgggttttcccgttaaccgggcgtaacgtcggggtaaccggttccggttaccggggggacccgaaacgggggaccccgacccgggtacccgtaccccgggttcccttaccccgttcccgtaccggtacccccttacccgaaacccccggaaacccggggtcccccgtaacgttccccggggtttccccctttcccccccgttccgggaccccgtaccccccgttaccccttaccccgaaaccggaccgacccgtaaccccgttccgggtaccggggggcccaaaccggaaccggccccggggtcccccggttacgggggccgttccgggtcccggttacgggttaaacccgg

SEQ ID NO: 373424 - DNA, 806 bp, Homo sapiens
  misc_feature: GZ8MTXP02IPN49.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgcttattttagaaggtgtccagtgtgaggtgcgaggttgggtgggaggttcggtggggggaggtctttcgggtcccgaaccggttggggggggtccccttggaagtacccgtcttcccgttggttcgccacgtcccttccgttggtacttctaattacttttaaagtttaggtttttggatcggtaccgtcggggtccccgtccggacggggtaccggaaggggaacgggggtccgttaggggagggttgggggtacgggaacccctaaaacgtaaagtaaaacggacgaaaaggtaggtaagggaaaggttaggaaagtaaaattacgttaagtagggttaggtaaccttcggtggggtacgggaacggggaccggtacttacccgaacctacttcccgaccgaaagggaaaccaacccgaaacccggaacgtaaaaacgttaactttaaccgtagttactacgtagaaactaaagtacgaaactacggcgtaggaacggacggacggaagaccgtacggtcttagttacgttacgttactgggacgtacggaaacgttcctacccttccggacggtgggaccccgggttaactacggggtttaccgacggcgtaacggttccggaacgtttcccggg

SEQ ID NO: 373425 - DNA, 764 bp, Homo sapiens
  misc_feature: GZ8MTXP02I2E1U.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagcttgggttttccttgttgctattttagaaggtgtccagtgtgaggtgcagttggtggagtcgtgggggaggcttgggtcccaaccgttggggggtcccctggagtacctctcctgtgcagcctctggattcattctttaatagttttgattgaccgtgggtccgccgagggtccgaagggaggggctggaggtgggtgaccaacgaactaaagcaaggaagtgggaaagtagaaagtaaacttacgtagttggtagtaccttcgtagggtacggaaacggggcccgtagttacaccatttacccaccgaagaacgaaccgaaaccgtaccgtaaaagtaaacctttaccgtaggttaactaccgtagaaccgttaaaaagtcggaaaacccgtcggacgtagggaacgggacggggaacccggaaacgggtacccggtacggtacctttacgttaacgtttaacgttacgtacgggtacgaccgggtaaacgttacccgttaccccgttacccggttccgggttaccggggtaccccgggttaaccggtttaacccgggtttacccgacggggttaacccgtacgggttaccgggtaacccggggtttccggg

SEQ ID NO: 373426 - DNA, 806 bp, Homo sapiens
  misc_feature: GZ8MTXP02F31AZ.15.87.H10.1.454.CMB.2.raw
  modified_base (234)..(234): a, c, t, g, unknown or other
  modified_base (271)..(271): a, c, t, g, unknown or other
  modified_base (292)..(292): a, c, t, g, unknown or other
  modified_base (297)..(297): a, c, t, g, unknown or other
  modified_base (322)..(322): a, c, t, g, unknown or other
  modified_base (333)..(333): a, c, t, g, unknown or other
  modified_base (369)..(369): a, c, t, g, unknown or other
  modified_base (437)..(437): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcattcttttaatagtttttggatgacctgggtccgcagggtccagggagggctggagtggtgaccaanataaagcaagatggaagtgaagaaatctatgtgactntgtagaaggccatcaccatcncaganacaacgcaagactttatgtactctnacaaatgaacngcgtggagaggcgaggacaccgctactgtattacgngtacgcggaaaggtactacccgtcctcgggtacggggccgggtaccctacgggttttcccaaccgggntaacggtacggggtacccggtttacgggaccgggggtaacccgaaacgggggtaaccccgtaaccggggtaccctaaaccccgggttcccgttacccctaaccggacccgtacccccgttaacccccggaaacccggaaaacccgggggtccccccttaaacgggtttcccccggggttaaccccttttccccccccgggaccggtaccccctacccccccggtttaaccctacccggtaaaacgggaccccgtaccgtaaaccccggtttccggggtaccgggggaccaacccggaaccgggggttaccccggacccgggttacgggggccctttaccgggccccggttacggggtttaaaaccccgg

SEQ ID NO: 373427 - DNA, 737 bp, Homo sapiens
  misc_feature: GZ8MTXP02HNI9B.15.87.H10.1.454.CMB.2.raw
  modified_base (300)..(300): a, c, t, g, unknown or other
  modified_base (305)..(305): a, c, t, g, unknown or other
  modified_base (322)..(322): a, c, t, g, unknown or other
  modified_base (324)..(324): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattctttaatagtttttggatgacctgggtccgcgagggtccagggaaggggctgggaggtgggtggaccaacataaagcaagatggaaagtgaagaaatactatggtgactgtgtggaaggcatcacatcncaganacaacgccaaagacttntntatctgacaaaagtgaaacagtccgtaggaaggacgggacgtaagggaaccgacccggtaccttcgttagtttaacttacgtggttacggacggtacggtacttacccgtcccgttcggtcggggccgggtaccgtacggtttacccgtacggcgtacgtcggacggttcggtcgggggaccgaaacggggacccgtaccgggtaccgacccggttcctaccctacgtaccgccccgtacccgaacccgaaccgggtacccgtaccgttcccggttccccgtttcccccgaccgggtacccctacccccgtacctacccgaaaacgccgtaccgtaacccgtcgggtacggggaccacggaaccggtccggtccccgggtcggtaccgtcggtcccggttacgggtaacccgg

SEQ ID NO: 373428 - DNA, 617 bp, Homo sapiens
  misc_feature: GZ8MTXP02HUVLA.15.87.H10.1.454.CMB.2.raw
  modified_base (204)..(204): a, c, t, g, unknown or other
  modified_base (240)..(240): a, c, t, g, unknown or other
  modified_base (410)..(410): a, c, t, g, unknown or other
  modified_base (567)..(567): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtcccctgagactctcctgtgcagcctctggattcattcttttaattagtttttggatgacctgggtccnccagggtccagggagggctggagtgggtgaccaaanataaagcaaagatggaaagtgaagaaatactagtggtggacttctggtagaagggcctattcaccatcctccagacgacaaacgacctaaagacttactgtatctagacaaatcgaaactagccgtaggaagacgggacgtaaggacctacggccttagtgtaatttcgngtcgcgagtactccgtcgtgcgggacgtaccgtacgttccgacgctagtcggacgtcggacgggacgaacggaccgacgtccgaccgtctccgcgacgccctaccaccgaacggcccacgtccgttccctcccacgaccctaccctccacgacgacnccaccgtcggcggccacgaacggccggtccgcggtcgacgccgtacgacg

SEQ ID NO: 373429 - DNA, 690 bp, Homo sapiens
  misc_feature: GZ8MTXP02F553W.15.87.H10.1.454.CMB.2.raw
  modified_base (353)..(353): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagcttgggttttccttgttgctattttagaaggtgtccagtgtgaggtgcaggttggtggagtcgtgggggagtcgttggtccgaaccggtggggggtccctggacgtactctcctgtgcacgcctcgtggtattcattctttaattgttttgatgaccgtcggtccgcgaggtccgagggagggcgtggaggtggcgaccaanaagtaaacgcgaaagagtaggaaagtgaaagtaaatactagtcgtagtacttcgtggtaggaacggggtcctattcccactactccgtaccaagaacgaaccgaaaccgacctaaagtaaccttacgtacgttaactcgtaacgtactaaaagtcgaaaaccgcgtaccgtaggaacgggacgggaccgaagggtacccgaacgggtcttacgttacggttaacttcggtaggtacggacggtaacggttaccttacccggtccgtacggtaccgggccgggttaacccgttacgggtttacccgaaggtccgtaaggtccgggtacgtacccgggg

SEQ ID NO: 373430 - DNA, 670 bp, Homo sapiens
  misc_feature: GZ8MTXP02G0XO6.15.87.H10.1.454.CMB.2.raw
  modified_base (202)..(202): a, c, t, g, unknown or other
  modified_base (270)..(270): a, c, t, g, unknown or other
  modified_base (286)..(286): a, c, t, g, unknown or other
  modified_base (289)..(289): a, c, t, g, unknown or other
  modified_base (294)..(294): a, c, t, g, unknown or other
  modified_base (309)..(309): a, c, t, g, unknown or other
  modified_base (360)..(360): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtgggggggtccctgagactctcctgtgcagcctctggattcattctttaatagtttttggatgacctgggtccncgagggtccagggagggctggagtgggtgccaacataaagcaagatggaagtgaagaaatctatgtgntctgtgaggcatcacntcncaganacacgcaagacttcngtatctagacaaatgaacagcctggaagacggacgacggactacggccttntagttacttacgtggtcggcggtaacggacctacccgttccgtcggtacggggcccgggtacccgtacgggtttcccacgggactacggttcgggaccgttcggacgggggacccgaaacggggtacccgaaccgggtcctacccggtcctccgtccgacctccccgtacccgaacccgaaccgggcccctacgttcccggtaccccttccccgcgacccctaccccttccaaccgaacgacgccccgtaccgttcgggaccgggaccacgccggcccggcgtcggggacctcggtccgtcggtaacccg

SEQ ID NO: 373431 - DNA, 659 bp, Homo sapiens
  misc_feature: GZ8MTXP02JYF1J.15.87.H10.1.454.CMB.2.raw
  modified_base (269)..(269): a, c, t, g, unknown or other
  modified_base (640)..(640): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggagggctggagtgggtgccaacataaagcaagatggaagtgagaaatactatgtgactntgtgaaggccgattcaccatctccagagacaacgccaaagaacttactgtatctgacaaatgaacagcctagacggaggcgaggacaccggctctgttattacgtgtgcgaggactaccctcctcgtcgggccgggtccgtacggtttcccgtaccggcgtacgtgggaccgtcgtcgggggaccgaaacggggtacccgacgggtaccaacccggttccgtcccgtcgtaccgaccccgttacccgaacccgaaccggggtaccccaacgttcccgggttccccttccccccgtcggacccctaccccgtcctacccgacgaacgccaccgttccggcgggggaccacgaacggccgtcccgtcgggtcnccggtccgtcggtaaccgg

SEQ ID NO: 373432 - DNA, 651 bp, Homo sapiens
  misc_feature: GZ8MTXP02H7Q5E.15.87.H10.1.454.CMB.2.raw
  modified_base (378)..(378): a, c, t, g, unknown or other
  modified_base (412)..(412): a, c, t, g, unknown or other
tcagtctacgtagccacgaccggtgctcgatttagcagtactgcgttgggttttccttgttgctattttagaaggtgtccagtgtgaggtgcagttggtggagtcgtggggggaggcttggtccaaccgtgggggggtccctgagactctcctgtgcagcctctggattcattcttttaattagtttttggatgacctgggtcccgcgagggtccgaaggggaaggggctgggagtggggtcggaccaaacaataaagcaaagagtaggaaagtagaagaaatactagtggtaggacttcgtggtggaagggccgattcaccatcctccagagaaccaacgaccaaagtaacttactgtaatctagacaaatgaaacngcctagagaggcgaggacacggctcgtgtattcngtcgcggaggtactaccctccgtcgtcgggccgggtccgtacgttccgacggctagtcggacgttcggcggggtaccgaacggggaccgaccggtccgtacccgtccttccgtcgacgccccgtaccaccggaaccggaccctacgtcccggtcccttccccgcgccctacccctcctcgaacgcaccgaccgttcggacgggcacgaacgccggccgtcggctcgcgtacggtaaccg

SEQ ID NO: 373433 - DNA, 709 bp, Homo sapiens
  misc_feature: GZ8MTXP02IBPFM.15.87.H10.1.454.CMB.2.raw
  modified_base (337)..(337): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctggggggtccctgagactctcctgtgcagcctctggattcatctttaatagtttttggatgacctgggtccgccagggtccagggaagggctgggagtgggtgccaacataaagcaagatggaagtgagaaatactatgtggactctgtgaggccgattcaccatcctcagagacaacgccaaagacttactgtatctgacaaatgaacngcctagagaggcgaggacgaccggctctgtacttacgtggtgccggtaaggacttacccgtcccttcggtacggggccggggtacccgtacgggtttacccgacgggtccgagtcgggaccgttcggtcgggggaacccggaaacggggaacccgaccggtaccgtacccggttcctcccgtaccgacggtccccctacccgaaccccgaaccgggggacccctacgttcccgggttcccttaccccccggtcggacccctacccccgtcccttacccgaaacgtacgtacccgtacccgtcggtacgggggaccaccggaacgggcccggtaccccggtcggggtcctccggtaccgtacgggtaacccgg

SEQ ID NO: 373434 - DNA, 618 bp, Homo sapiens
  misc_feature: GZ8MTXP02JHXK0.15.87.H10.1.454.CMB.2.raw
  modified_base (383)..(383): a, c, t, g, unknown or other
  modified_base (428)..(428): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcttggtccaaccgtggggggtccctgagactctcctgtgcagcctctggattcatctttaatagtttttgatgacctgggtccgccagggtccgagggaggggctggagtgggtggaccaagataaagcaaagataggaaagtgaagaatactatgtgactntgtgaacgggcattcacatctacagagacaacgcaaagtacttangtatctagacaaatcgaacacgcctaggaggaggcggaagggacaccgggccttagttagttaacttaccgtggttcggacggtaacggtacttaccccgttaccgtccggttaccgggggccgggtaacccgttacgggtttttaccccgacgggtcctacggttccggggtaaccggttacccggggg

SEQ ID NO: 373435 - DNA, 709 bp, Homo sapiens
  misc_feature: GZ8MTXP02IQYAW.15.87.H10.1.454.CMB.2.raw
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttccttgttgctattttagaaggtgtccagtgtgaggtgcagttggtggagtcgtgggggaggcgttggtccaaccgtggggggtccctgagactctcctgtgcagcctctggattcattctttaatagtttttggatcgaccgtgggtccgcgaggggtccaggggaacggggcgtgggaggtggggtcggaccaaacgaagtaaaagacaaagagtaggaaaggtagaagtaaaatactagtgtaggacttcgtggtagaaacggggccgtaagtttaccacctacttacccgtacccgaaggaaaccggaaccaaaccggacccaaaagtaaaccctttaacgtagtaaactccgtagacctaaaagttcgaaaaccgtacggacgttagggaagggaacggcggaaacggaacgaccgggtactttaccgtagttaaacttacgtggtacgaccggaaggttaaacctcccgttacccgtcggtcgggccggggttaacccgtacgggttttacccgacggactacggtccggtacgttaccggggg

SEQ ID NO: 373436 - DNA, 613 bp, Homo sapiens
  misc_feature: GZ8MTXP02IJS3P.15.87.H10.1.454.CMB.2.raw
  modified_base (321)..(321): a, c, t, g, unknown or other
  modified_base (376)..(376): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctggggggtccctgagactctcctgtgcagcctctggattcatctttaatagtttttggatgacctgggtccgccagggtccagggaagggctgggagtgggtggccaacataaagcaagatggaagtgaagaaatactatgtggactctgtgaagggccattcacatctccagagacaacgccaaagactttacngtatctgcaaaatgaacagcctgagaggcgaggacaccggctcgtgtatacgtgngcgaggataccctctctgggccgggtcctacggtttccgtacggtcgagtcgggacgtcgtgggggacccgaacggggaccaccggtcacccggtcctccgttccacgccctacccaacccgaacggccccacgtccggtccttcccccgtcgcccacccctcctaccaacgacgaccgtacctccgtcgggggccaccgaacggcggcccgtcgggccgtcggccgtcggtaaccg

SEQ ID NO: 373437 - DNA, 665 bp, Homo sapiens
  misc_feature: GZ8MTXP02HXUF2.15.87.H10.1.454.CMB.2.raw
  modified_base (228)..(228): a, c, t, g, unknown or other
  modified_base (234)..(234): a, c, t, g, unknown or other
  modified_base (338)..(338): a, c, t, g, unknown or other
  modified_base (533)..(533): a, c, t, g, unknown or other
  modified_base (609)..(609): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattctttaatagtttttggatgacctgggtccgcagggtccagggaggggctggagtggngccaanataaagcaaagatgggaatgaagtaaatactatggtggactcgtgtaggaaggggcctattcaaccattcaccagacgacaacgacaaagaacttactagtacnctagacaaaatgaaacacggcctaggaggacgggacggaacggacctaccggggcttaccgtaggttaactttagtgtcggcggaggtaccttacccgtccgttcgtcggggtccgggtacccgtacggtttcccgtacggcgaagtcggtacgtacggtcggggaccgaacggggaccgacggtccaccgttcnccctcgacgccctaccgaccgacggccctacgtccgtccttccccgtgtacccgcccctaccctacaacggtaccncgaccgtcggacgggcaccggccggtccggtaccgtcggccgtcgtcgtcggtacg

SEQ ID NO: 373438 - DNA, 627 bp, Homo sapiens
  misc_feature: GZ8MTXP02JSHAJ.15.87.H10.1.454.CMB.2.raw
  modified_base (343)..(343): a, c, t, g, unknown or other
  modified_base (368)..(368): a, c, t, g, unknown or other
  modified_base (380)..(380): a, c, t, g, unknown or other
  modified_base (404)..(404): a, c, t, g, unknown or other
tcagtctacgtagccacgaccggtgctcgatttagcagtactgcgttgggttttccttgttgctattttagaaggtgtccagtgtgaggtgcagttggtgggagtctgggggaggcttggtccaacctgggggggtccctgagactctcctgtgcagcctctggattcatctttaatagtttttggatgacctgggtccgccagggtccaggggaagggctgggagtgggtggccaaacataaagcaagatggaagtgaagaaatactatgtggactctgtgaagggccattcaccatctccagacacaacgccaaagacttactgtatctgacaaatgaacngcctagaggagcgaggacacccggntctgtattacgngtcgcgaggacttaccctcgtcgnggggccggcctacggtttccctacggcagtcggcgtcgtcgggggaccgaaacggggacccgacggtaccgacccggtcctcccgtcgacgccctccgaacccgaccgggcccacgtccggtcccttcccccgtcggccctacccctaccctacccaacgacgccaccgtcggtcggggccacgaacggcccggtccgtcgggcctcggtccgtacggtaccg

SEQ ID NO: 373439 - DNA, 605 bp, Homo sapiens
  misc_feature: GZ8MTXP02FQGP6.15.87.H10.1.454.CMB.2.raw
  modified_base (199)..(199): a, c, t, g, unknown or other
  modified_base (236)..(236): a, c, t, g, unknown or other
  modified_base (296)..(296): a, c, t, g, unknown or other
  modified_base (372)..(372): a, c, t, g, unknown or other
tcagtctacgtagccacgaccggtgctcgatttagcagtactgcgttgggttttccttgttgctattttagaaggtgtccagtgtgaggtgcagttggtggagtctgggggaggcttggtccaacctgggggggtccctgagactctcctgtgcagcctctggattcatctttaatagtttttggatgacctgggtccnccagggtccagggaaggggctggagtgggtggccaanataaagcaagatggaagtgagaaatactatgtggactctgtgaagggccattcaccatcncagagacaacgccaagacttactgtatctgacaaatgaacagcctgagaggcgaggacaccggctctgtattacgngtgcggagactaccctccgtcgtggggcccgggaccgtacggtttcccgtacggcacgtaggacgtcgtgggggaccaaacggggaccacgggtcacccggtcctcctcgacgccctaccgaccgaacgggcccacgtccgtcctccccgtcgcccaccctcctaccaacgcgaccaccgtcgtcggggaccacgtaacggccgccggtcgggcctcggaccgtcggtaaccg

SEQ ID NO: 373440 - DNA, 610 bp, Homo sapiens
  misc_feature: GZ8MTXP02GUCS5.15.87.H10.1.454.CMB.2.raw
  modified_base (331)..(331): a, c, t, g, unknown or other
  modified_base (341)..(341): a, c, t, g, unknown or other
  modified_base (461)..(461): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaaccgtggggggtccctgagactctcctgtgcagcctctggattcattctttaatagtttttggatgaccgtgggtcccgccagggtccaaggggagggctggagtgggtgaccaacataaagcaaagatggaaagtgaagaaatactatgtggactctgtagaacggccattcaccatcaccagacacaacgcctaaagaacttacngtatcgaganaaaactgaaaccagcctaggaagaggcgagaactccgctctagttaattctggacgcggagaaaccttccgtccgtgtcgggaacgggtcctagtttccacggcaagtcggaacgttcgnggggaccaaagggcccaacggtcaaccgttcctacttacgacctccgaacgacggtcccagttcccggtcttcccccgagacccaccctctacgaacgcacgtccgtcggtacggacacgcgcgtccgcggtctcgacgtcgacgaacg

SEQ ID NO: 373441 - DNA, 666 bp, Homo sapiens
  misc_feature: GZ8MTXP02GR5WM.15.87.H10.1.454.CMB.2.raw
  modified_base (280)..(280): a, c, t, g, unknown or other
  modified_base (301)..(301): a, c, t, g, unknown or other
tcagtctacgtagccacgaccggtgctcgatttagcagtactgcgttgggttttccttgttgctattttagaaggtgtccagtgtgaggtgcagttggtggagtcgtgggggaggcttggtccaaccgtggggggtccctgagactctcctgtgcagcctctggattcattctttaatagtttttggatgacctgggtccgccgaggggtccaggggaagggctggaggtgggtggccaacataaagcaagatggaagtgaagaaatactatgtggactntggtgaacggccatcacatcncagacgacaacgccaaagaacttactagtatctagacaaaagtcgaaacacgccgtaggacggaggggacgaaggggacctaccggggcttaccgtagttaactttacgtggtcggcggaacgggtacttacccttccgtcgtacggggcccggtaccgttacgggtttcccgtaccggctagtcggtacgtcggtcggggaccgaacgggaccgacggtccaccgtcctcctccgacgccctaccaaccgaccgcccgtacgtcccgtcccttccccgccggcccaccccgtcctaccacgacgccaccgtccgtcggggaccacgaacgcccggccggtcggccgtcggccgtacggtaaccg

SEQ ID NO: 373442 - DNA, 829 bp, Homo sapiens
  misc_feature: GZ8MTXP02GUCRI.15.87.H10.1.454.CMB.2.raw
tcagtctacgtagccacgaccggtgctcgatttagcagtactgcgttgggttttccttgttgctattttagaaggtgtccagtgtgaggtgcagttggtggagtcgtggggggaggcttggtccaaccgtgggggggtccctgagactctcctgtgcagcctctggattcattcttttaatagtttttggatgaccgtgggtccgccgagggtccgaaggggaaggggctgggaggtggggtcggaccaaacataaagcaaagatagggaagtagaagtaaatactagtggtggacttcgtaggtaggaacggggtccgaattaccaccatcctaccgaaaggacgaaccaacgaccaaagtaacctttactgtaactctagaacaaaatacggaacagccgtggacggaggacgaggaccgacccggtcctgtaggttactttcgtgggtacgccggtaaggaacccttccgtacccgttcgggtacgggggaccccgggttcccggttacggtttacccggaccggtacgtacggttacggggtaccggttcggtaccgggggaacccgtaaacggggacccgtacccgtacccgtaacccgtcccgtccgtacccgaccgccccgttaacccgaacccggtaacccggggcccctaccggttcccggttcccccttcccccggtaccggtacccccacccccgttaccccgtacccgtaaacgacccggtacccacccgggttgggacccgggggaccaaccggccgggtccccggggtacccggttcggggcccgttacgggtcccggttacgggttaaacccgg

SEQ ID NO: 373443 - DNA, 633 bp, Homo sapiens
  misc_feature: GZ8MTXP02I7NXS.15.87.H10.1.454.CMB.2.raw
  modified_base (333)..(333): a, c, t, g, unknown or other
  modified_base (352)..(352): a, c, t, g, unknown or other
  modified_base (573)..(573): a, c, t, g, unknown or other
tcagtctacgtagccacgaccggtgctcgatttagcagtactgcgttgggttttccttgttgctatttttagaaggtgtccagtgtgaggtgcagttggtggagtctggggggaggcttggtccaaccgtggggggtccctgagactctcctgtgcagcctctggattcatctttaatagtttttggatgacctgggtccgccgagggtccaggggaaggggctgggaggtggggtggccaaacataaagcaagataggaagtgaagaaatactatgtggactcgtgtgaagggccattcaccatctcagagaccaacgccaaagtacttacngtatctgacaaaatgaacngctgagagggcgagggaccaccggtctcgttagtatttcgtggtcgcgaggactacctcccgtgtacggggccggtccgtacgtttccctaacggctagtcgggacgtcggtacgggggaccaacggggccgacggtcctaccgtcctcctcaccgccctccgaaccgaccggccctacgtccggttccctccccgtcgccctaccctccctacgacgacnccgaccgtcggtcggggccacggcggcccggtccgcggggtctcggaccgtcggtaaccg

SEQ ID NO: 373444 - DNA, 600 bp, Homo sapiens
  misc_feature: GZ8MTXP02JK6SE.15.87.H10.1.454.CMB.2.raw
  modified_base (274)..(274): a, c, t, g, unknown or other
  modified_base (292)..(292): a, c, t, g, unknown or other
  modified_base (297)..(297): a, c, t, g, unknown or other
  modified_base (364)..(364): a, c, t, g, unknown or other
  modified_base (369)..(369): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcatctttaatagtttttggatgacctgggtccgccagggtccagggaggggctggagtgggtggccaacataaagcaagatggaagtgagaaatactatgtggactntgtgaaggcatcacatcncaganacaacgcaagatcagtatctagcaaaatgaaacagcctagagagcgagacaccgctgtactattacngtcgngagactacctcctgtggccgctacgttctacgcagtggacgtcgcgggacaaacgggaccacgtcaccgtctccgtctacgcctaccgaccgaaacggtccccaagtccggtcccttacccccgtcgcccacccgtacctaccgaacgtaccgaccaccgttccggcgggggtacccaacggaacgtcccgggcccgtacggggtcccgtacgtccgtaggttaaacccgg

SEQ ID NO: 373445 - DNA, 620 bp, Homo sapiens
  misc_feature: GZ8MTXP02GJT4S.15.87.H10.1.454.CMB.2.raw
  modified_base (266)..(266): a, c, t, g, unknown or other
  modified_base (440)..(440): a, c, t, g, unknown or other
tcagtctacgtagccacgaccggtgctcgatttagcagtactgcgttgggtttgggggtctcagagaggagccttagccctggactccaaggcctttccacttggtgatcagcactgagcacagaggactcaccatggaattgggactgagctgggttttcctgttgctattttagaaggtgtccagtgtgaggtgcagttggtggagtcgtgggggagtcttggtccaaccgtggggggtccctggagactctctgtgcagcctntggattcattcgtttaatagttttggacttgacctggtccgcagggtccagggtaagggctaggagtggggtagcctaaacgataaacgcaagagtacggaaagtgaacgaaatacaagtgcggaactctaggtgaaaggcccgtatcgacagtcaccagagactaacgcaaanaaccctttagacgtatcgacacggaaaatacgaacacgaccgagacgaggaccgaggacgaacggacctaacgtcggtacttacgtacgttacgacggttaggacgtaacccgtaaccttaccgtcggtaccgggaaccgtacgttaccgttacgacccgaacgtggtacgttaaccggg

SEQ ID NO: 373446 - DNA, 705 bp, Homo sapiens
  misc_feature: GZ8MTXP02F2AVY.15.87.H10.1.454.CMB.2.raw
  modified_base (223)..(223): a, c, t, g, unknown or other
  modified_base (247)..(247): a, c, t, g, unknown or other
  modified_base (257)..(257): a, c, t, g, unknown or other
  modified_base (272)..(272): a, c, t, g, unknown or other
  modified_base (329)..(329): a, c, t, g, unknown or other
  modified_base (341)..(341): a, c, t, g, unknown or other
tcagtctacgtagccacgaccggtgctcgatttagcagtactgcgttgggttttccttgttgctattttagaaggtgtccagtgtgaggtgcagttggtggagtctggggggaggcttggtccaacctgggggggtccctgagactctcctgtgcagcctctggattcattctttaatagtttttggatgacctgggtccgcagggtccaggggagggctggngtgggtgccaacataaagcaaagntggaatgaanaaatctatgtggctntgtaggaaggccattcactatctcgagagaacaacgccaaagtaacttactgtatcngtacaatgaacngcctaggaggaggacgaggacgaccggtctacgttaggtaattacgtcgtagaccggtggtaacttcccgtaccctcggtacggggaccgggtcccgttaacgggtttccgtaaccggtacgtacgtcggtacggttcggcggggtaccgaaacggggacccgacggtaccgtcccggttaacctccgtaccgaccgtaccctacccgaaccgaaccggtaccccgtaccgtccggttccctccccgtccggtaccctacccccgtaccctacgaaccgtaccgaccgtaccgttaccggacggggtaccaccggaacggtcccggtcccggtcggaccgtttccggacgttaccggtaaccgg

SEQ ID NO: 373447 - DNA, 429 bp, Homo sapiens
  misc_feature: GZ8MTXP01A5NIV.52.83.H06.1.454.CMB.2.raw
  modified_base (420)..(420): a, c, t, g, unknown or other
  modified_base (422)..(422): a, c, t, g, unknown or other
  modified_base (424)..(429): a, c, t, g, unknown or other
tcagcgcagtacgacacgaccggtgctcgatttagatcacgtgcgtcgcggggcgggtgggggcacttctccctctaacactctcaccttcacttgccgggcgagtcaggacattagcaattatttaaattggtatcagcagaaaccagggaaagcccctaaactcctgatctacgatgcatccaatttggaaacagggtcccatcaaggttcagtggaagtggttctgggacacattttacttcaccatcagcggcctgcagcctgaagatattgcaacatatactgtcaacagtatggtaaatctcccactcactttcggcggagggaccaaggtcgagatcaaagactgcggctgcaccatctgtctcatcttcccgcatctgatatacgatcgctgagcgggctggcaaggccganangnnnnnn

SEQ ID NO: 373448 - DNA, 611 bp, Homo sapiens
  misc_feature: GZ8MTXP01A0DYJ.52.83.H06.1.454.CMB.2.raw
  modified_base (263)..(263): a, c, t, g, unknown or other
  modified_base (306)..(306): a, c, t, g, unknown or other
  modified_base (353)..(353): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtcgtgggggagcgtggtccagcctggggacgtccctgagactctctgtgtagcctntggattcaccttcgagggtctatgacatgcacgtggggtcccnccgaggcctccgagggcgaagggggctgggagtgggtgccttattanatacaaagtgaagtggaaataaacaaatactagtagtagtactccgtagaacgggcgattcaactatctaccagacaacaacgttaccaaagaatacgactagtactcgtagaccaacagtacgaacgacgccgtaggaacgaacgacccggaaagttacgtaaccggggtttgtttaacgttacgttaggtaaggtacccgtaaagtttaacggtaaccgggaaacggtaacccgttaaacccgggtaaccccccgg

SEQ ID NO: 373449 - DNA, 643 bp, Homo sapiens
  misc_feature: GZ8MTXP01EO8JK.52.83.H06.1.454.CMB.2.raw
  modified_base (179)..(179): a, c, t, g, unknown or other
  modified_base (306)..(306): a, c, t, g, unknown or other
  modified_base (354)..(354): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagcttgggttttcctcgttgcttcttttaagnggtgtccagtgtcaggtgcagatggtggagtcgtgggggagcgtggtccagcctgggacgtccctgagctctcctgtgtagcctctggacttcaccttcagggtctatgacatgcacgtggggtccnccaggcctccgagggcaagggggctgggaggtggggtgcctagtttanatacaaagtgaatgggaaataaacaaattactagtgtaacgactccggtagaaacgggccgtacttaccaacctattacctaccaagggaacaaacctaaattacccgaaagtaaacgttaccggtacttaggttaactccttacgacctaactagtacgaaaccgagtacccgtaggaacggacgaacccggaaaggttaccgtacggggtttattttagttcgttggtaacgtacgttaaacgtttaacgtacgggaacgtaacccgaacccgggttaaccccccgg

SEQ ID NO: 373450 - DNA, 441 bp, Homo sapiens
  misc_feature: GZ8MTXP01A81FB.52.83.H06.1.454.CMB.2.raw
  modified_base (395)..(395): a, c, t, g, unknown or other
  modified_base (399)..(399): a, c, t, g, unknown or other
  modified_base (426)..(426): a, c, t, g, unknown or other
  modified_base (434)..(441): a, c, t, g, unknown or other
tcagcgcagtacgacacgaccggtgctcgatttagatcacgtgcgtcgcggggcgggtgggggcacttctccctctaacactctcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacactattttacttcaccatcagcggcctgcagcctgaagatattgacaacatattactgtacaacagtatggtaatctccccattcactttcgggcggagggaccaagggtcagatacaaacgactgtcggctgcacatctgtcttcatcctcccgcatctnatanacgatcgctggagcgggctggcaggcncgataggnnnnnnnn

SEQ ID NO: 373451 - DNA, 644 bp, Homo sapiens
  misc_feature: GZ8MTXP01DUSIB.52.83.H06.1.454.CMB.2.raw
  modified_base (379)..(379): a, c, t, g, unknown or other
  modified_base (445)..(445): a, c, t, g, unknown or other
  modified_base (475)..(475): a, c, t, g, unknown or other
  modified_base (559)..(559): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagtcttgggttttcctcgttgcttcttttaagaggtgtccagtgtcagggtgcagatgggtggagtcggtgggggagcgtggtccagccgtgggacggtccctgacgtactctcctgtgtacgcctgtggacttcaccttcgagggtctagtgactatcgctacgtcgggtcccgcgaggcctacgacgggacggaacgggggcgtagggaggtggggtcgtacctatttanatactaaagtgaataaggaaataaacaaattactatgacgtactcggagacggcattcactatacncagacaactaactacaaagtaacgtacgtnttagtactctacgacaacgtaaactacgaaacctacgcccgtaggaaacggacgaaccggtaacggttaccggttacgggtttnttttaacgttcgttaggtaacggtaacgttaaacgttttaacggtaccgggaacggtaacccgttaaaccccggttaacccccgg

SEQ ID NO: 373452 - DNA, 668 bp, Homo sapiens
  misc_feature: GZ8MTXP01BCYGQ.52.83.H06.1.454.CMB.2.raw
  modified_base (267)..(267): a, c, t, g, unknown or other
  modified_base (368)..(368): a, c, t, g, unknown or other
  modified_base (520)..(520): a, c, t, g, unknown or other
  modified_base (534)..(534): a, c, t, g, unknown or other
  modified_base (588)..(588): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagcttgggttttcctcgttgcttcttttaagaggtgtccagtgtcaggtgcagagtggtggagtcgtgggggagcgtggtccagccgtgggacgtccctgagactctcctgtgtagcctntgattccaccttcgagggtctatcgacagtgacgtacgtcgggtccccgccgaggcctaccgagggacgagggggctgggaggtggggtgtacctatttanatacaaatgaataaggaaataaacaaattactagtacgtaacgacgttccggtagaaacgggtccgtaacttacaaccctaactccgtaccaaggacaaacctaacgttaacccgaaaggtaactaccggtactagttactctcgaacctanaacgtcgtaaaccncgggtacccaagggaaacgaccggaccgggtaaagttccgggttaacgggtttnttttaacgttcgttaggtcgtaaaccgtaagtttaacgggtacgggaaccggtaacccgttaaccccgggtaaccccccg

SEQ ID NO: 373453 - DNA, 460 bp, Homo sapiens
  misc_feature: GZ8MTXP02HZCCE.52.83.H06.1.454.CMB.2.raw
  modified_base (375)..(375): a, c, t, g, unknown or other
  modified_base (400)..(400): a, c, t, g, unknown or other
  modified_base (449)..(460): a, c, t, g, unknown or other
tcagcgcagtacgacacgaccggtgctcgatttagatcacgtgcgtcgcgggcgggtgggggcgacttcgtccctactaacactctcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacactattttactttcaccatcagcggcctgcagcctgaagatattgcaacatattactgtcaacagtatggtaaatctcccactcactttcggcggagggaccaaggtcgagatcaaaagactgtggctgcaccatcttntcttctactcctccctcctactctntatatacgtactcgcgtgaggcgggcgtcggacgacggcgacgagtagnnnnnnnnnnnn

SEQ ID NO: 373454 - DNA, 576 bp, Homo sapiens
  misc_feature: GZ8MTXP02HU92W.52.83.H06.1.454.CMB.2.raw
  modified_base (309)..(309): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtcgtgggggagcgtggtccagccgtgggagtccctgagactctcctgtgtagcctctggattcacctttcagggtctatcgacatcgcacgtggggtacccnccaggcctaccgagggcgaaggggctgggacggtggggtgacctagtttatatacaaatgaatcggggaaaataaacaaagttactagtagtacacgtcgtgaaacgggcaattcaaccatcgtacagacaactaattccaaagtaatacgtntgtatcganacacanacacacacgagacgacgacgaacgacgtacggttacgttacgttagtagtaagtacgtaacgttaacgtaacggaacggaaccgtaacccggtaacccg

SEQ ID NO: 373455 - DNA, 454 bp, Homo sapiens
  misc_feature: GZ8MTXP02GRDE8.52.83.H06.1.454.CMB.2.raw
  modified_base (287)..(287): a, c, t, g, unknown or other
  modified_base (397)..(397): a, c, t, g, unknown or other
  modified_base (427)..(454): a, c, t, g, unknown or other
tcagcgcagtacgacacgaccggtgctcgatttagatcacgtgcgtcgcggggcgggtgggggcacttctccctctaacactctcaccttcacttgccgggcgagtcaggacattagcaattatttaaattggtatcagcagaaaccagggaaagcccctaaactcctgatctacgatgcatccaatttggaaacaggggtccatcaaggttcagtggaagtggttctgggacacattttacttcaccatcagcggcctgcagcctgaagatattgcaacatatacngtcaacagtatggtaatctccactcactttcggcggaggaccaaggtcagatacaaagaactgtggctgcaccatctgtctcatcttcccgcatctgatatacgatccgntgagccgggctggacaaggcgtacagtagnnnnnnnnnnnnnnnnnnnnnnnnnnnn

SEQ ID NO: 373456 - DNA, 635 bp, Homo sapiens
  misc_feature: GZ8MTXP02F6HPO.52.83.H06.1.454.CMB.2.raw
  modified_base (266)..(266): a, c, t, g, unknown or other
  modified_base (279)..(279): a, c, t, g, unknown or other
  modified_base (304)..(304): a, c, t, g, unknown or other
  modified_base (346)..(346): a, c, t, g, unknown or other
  modified_base (350)..(350): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagcttgggttttcctcgttgcttcttttaagaggtgtccagtgtcaggtgcagatggtggagtcgtgggggaggcgtggtccagccgtgggagtccctgagactctcctgtgtagcctntggattcaccttnaggtctatgacatgcacgtgggccnccaggctccgaggcgaaggggctgggagtgggtgctatttanatanaaatgataggaaataaacaaatactagtagagtaccgtacgtagaacggcgtattaccaactactacctaccgaagaacgaaactaaacttaaccaaagtaaactaaccgtacgttagttaactacgtacgacaactaagtaacgaaacgaacgtaccgtaggaacggaaacggaaccggaaacggaaaccggttaacgggtttacgtttaacgttacgttagtaacgtaacgtaaaacgtttaaacgtaacggaaacggaaacccgtaaacccggtaacccccg

SEQ ID NO: 373457 - DNA, 427 bp, Homo sapiens
  misc_feature: GZ8MTXP02GN24V.52.83.H06.1.454.CMB.2.raw
  modified_base (419)..(419): a, c, t, g, unknown or other
  modified_base (421)..(427): a, c, t, g, unknown or other
tcagcgcagtacgacacgaccggtgctcgatttagatcacgtgcgtcgcggggcgggtgggggcacttctccctctaacactctcaccttcacttgccgggcgagtcaggacattagcaattatttaaattggtatcagcagaaaccagggaaagcccctaaactcctgatctacgatgcatccaatttggaaacagggtcccatcaaggttcagtggaagtggttctgggacacattttacttcaccatcagtggcctgcagcctgaagatattgcaacatattactgtcaacagtatggtaatctccactcactttcggcggtagggaccaaggtcgagatcaaacgactgtaggctgcaccatctgtctcatcttccgcatctgatatacgatcgctgagcggctggcgaagcganannnnnnn

SEQ ID NO: 373458 - DNA, 557 bp, Homo sapiens
  misc_feature: GZ8MTXP02G7QS2.52.83.H06.1.454.CMB.2.raw
  modified_base (308)..(308): a, c, t, g, unknown or other
  modified_base (353)..(353): a, c, t, g, unknown or other
  modified_base (410)..(410): a, c, t, g, unknown or other
  modified_base (415)..(415): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagctgggttttcctcgttgcttcttttaagaggtgtccagtgtcaggtgcagatggtggagtcgtgggggagcgtggtccagccgtgggacgtccctgagctctcctgtgtagcctctggattccacctttcgaggtctatgacatgcacgtggggtcccnccaggctccgagggcgaaggggctgggagtggggtgcctatttanatacaaatgaatgggaaataaacaaatactatgtagactcgagacggcatcacatcncaganacaataccaagatacgctagtatctagacacatacgaacagcctagacgacgaccgaaacgtacgtacgggttagttacgttacgtagtaacgtacgtaaacgttaacgtacggaacggtaaccgaacccggtaacccccgg

SEQ ID NO: 373459 - DNA, 624 bp, Homo sapiens
  misc_feature: GZ8MTXP02I5PZU.52.83.H06.1.454.CMB.2.raw
  modified_base (263)..(263): a, c, t, g, unknown or other
  modified_base (276)..(276): a, c, t, g, unknown or other
  modified_base (288)..(288): a, c, t, g, unknown or other
  modified_base (304)..(304): a, c, t, g, unknown or other
  modified_base (355)..(355): a, c, t, g, unknown or other
  modified_base (480)..(480): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagcgtgggttttcctcgttgctcttttaagaggtgtccagtgtcaggtgcagatggtggagtcgtgggggagcgtggtccagccgtgggagtccctgagactctctgtgtagcctntggattcaccttnaggtctatgacntgctacgtgggtcccnccaggtccttcgagggcgaaggggtctggggagtggggtgacctagtttanatacaaatgaatggggaaataaacaaattactaagtagtacgtactaccgtaggtaaacgggcctaattccaacctagttccaccgagaacgacaattaccaaagactaacgtctagttatctanacctaacagtacgaacgtacgaccgtaggaacgacggaaccggaaacggtaacggtaacgggtttactttaacgttacgtaggtaacgtaacgttaaacgttaacggtaacggaaccggtaacccggtaacccggtaacccccg

SEQ ID NO: 373460 - DNA, 550 bp, Homo sapiens
  misc_feature: GZ8MTXP02G5NRR.52.83.H06.1.454.CMB.2.raw
  modified_base (265)..(265): a, c, t, g, unknown or other
  modified_base (304)..(304): a, c, t, g, unknown or other
  modified_base (343)..(343): a, c, t, g, unknown or other
  modified_base (413)..(413): a, c, t, g, unknown or other
  modified_base (446)..(446): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagcttgggttttcctcgttgcttcttttaagaggtgtccagtgtcaggtgcagatggtggagtcgtgggggagcgtggtccagccgtgggacgtccctgagactctctgtgtagcctntggattcaccttcaggtctatgacatgcacgtgggtccncaggctccgagggcaaggggctggagtgggtgctattanatcaaatgatgggaaataaacaaatactatgtaagactccgtagaacgggcattcactatcctacaaganactaattaccaaagaaatacggctagtactacncgacacatagaacagactagaacgacgacgaacgacgtacggttattactacgtagtaagtacgtaaacgttaacgtacggacgtaaccgtaacccggtacccg

SEQ ID NO: 373461 - DNA, 594 bp, Homo sapiens
  misc_feature: GZ8MTXP02JPPM3.52.83.H06.1.454.CMB.2.raw
  modified_base (313)..(313): a, c, t, g, unknown or other
  modified_base (470)..(470): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagcttgggttttcctcgttgcttcttttaagaggtgtccagtgtcaggtgcagatggtggagtcgtgggggagcgtggtccagccgtgggagtccctgagctctcctgtgtacgcctctggtacttccacctttcgagggtctatgacatcgcacgtggggtcccnccgaggcctccgagggcgaaggggctggggagtggggtgcctatttagatacaaagtgaatgggaaacttaaacaaattactagtgtaagaccgtaccgtagaacgggacgattccaaccctatccaccaagagaacaattaccaaagtaactacgntagtatcagacacagtaacacacgacgacgacgacgacgaacgaacggtacggttacgttacgttacgtagtaagtacgtaacgttaacgtaacggtaacggtaaccgtaacccggtaaccccg

SEQ ID NO: 373462 - DNA, 442 bp, Homo sapiens
  misc_feature: GZ8MTXP02FQ71U.52.83.H06.1.454.CMB.2.raw
  modified_base (273)..(273): a, c, t, g, unknown or other
  modified_base (433)..(442): a, c, t, g, unknown or other
tcagcgcagtacgacacgaccggtgctcgatttagatcacgtgcgtcgcggggcgggtgggggcacttctccctctaacactctcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagntatgcaacatattactgtcaaacagtatggtaatcctcccactcacgtttcggcggagggaccaagggtcgagatacaaaagaactgtggctgcaccatctgtctcatcttcccgcatctgatatacgatcgctgagcgggactggcaaggcgacatagnnnnnnnnnn

SEQ ID NO: 373463 - DNA, 597 bp, Homo sapiens
  misc_feature: GZ8MTXP02JDJ0H.52.83.H06.1.454.CMB.2.raw
  modified_base (264)..(264): a, c, t, g, unknown or other
  modified_base (307)..(307): a, c, t, g, unknown or other
  modified_base (353)..(353): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtcgtgggggagcgtggtccagccgtgggagtccctgagactctcctgtgtagcctcnggatccaccttcgagggtctagtcgacatgcacgtcgggtccnccgaggctccgaggcgaaggggctgggaggtggggtgcctatttanatcaaatgatggaaataaacaaattactatagtagacctcgtaggtaacggccgtattacacctatcctaccagagactaattaccaaagaatacggcttagtacttactacgcacgtatacgaactacgcctaggaacgacggaaccggaaagaccggtaacggggtttctttaaagtaccgttagtgtacgtaaaaccgtttaagttacgggaaacgtaacccgaacccggttaacccccgg

SEQ ID NO: 373464 - DNA, 799 bp, Homo sapiens
  misc_feature: GZ8MTXP02IJAFF.52.83.H06.1.454.CMB.2.raw
  modified_base (161)..(161): a, c, t, g, unknown or other
  modified_base (176)..(176): a, c, t, g, unknown or other
  modified_base (243)..(243): a, c, t, g, unknown or other
  modified_base (323)..(323): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagctgggttttccngttgctcttttaagnggtgtccagtgtcaggtgcagatgggtggagtcgtggggggagcgtggtccagccgtgggacgtccngagctctcctgtgtacgcctgtggtacttccacctttcgaagggtctagtgaactagtcgaccgtacgttcggggccccnccgacggtcccgtaccggaggggaccgggtaacggggtcggtagggggtaggggttcggggtacgtaaccctttaaagttttaacgaacgttaaacgtaaaaggtaggtaaacggttaacggggtaaaaacgttaaaaactaaacgtttaacgttaagttacggtaaacgtacccggttaaccgggtaagggaaaccggtacccgtaacttacccaacccgttactacccgaaccgaaagaaaccgtaaaccttaaacgtaaaccgaaagtaaccgtacgttacgttacgtactaccgacgtaactaacgtacgtaacgaacgtaacgtacgtaacggaacggaacggaaccggaaacggtaaaccggttaacgggtttacgtttacgtttaacgttacggttaacggtaaacgttaaacggttaaacggttaaaccggtaaaccggtaaacccggtaaaccccggtaaaccccgg

SEQ ID NO: 373465 - DNA, 596 bp, Homo sapiens
  misc_feature: GZ8MTXP02JOGYF.52.83.H06.1.454.CMB.2.raw
  modified_base (304)..(304): a, c, t, g, unknown or other
  modified_base (503)..(503): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtcgtgggggagcgtggtccagccgtgggagtccctgagactctcctgtgtagcctctggattcaccttcgaggtctatgacatgcacgtcgggtccnccaggcctccgagggcgaaggggctggggaggtggggtggcctatttatatacaaagttcgatagggaaattaaacgaaattactagtagtaagtacctaccgtagaacggaccgtacttccaaccacttcctaccaagaacgaactaaacttaaccaaagtaacttacgactagtactacgtgacaacatagaaaccncgacagacgacgacgacgacgtacggttacttacgtacgtagaacgtaacgtaaacgtacggtaacggaacgtaaccgtaacccggtaacccg

SEQ ID NO: 373466 - DNA, 598 bp, Homo sapiens
  misc_feature: GZ8MTXP02F2Q9S.52.83.H06.1.454.CMB.2.raw
  modified_base (294)..(294): a, c, t, g, unknown or other
  modified_base (339)..(339): a, c, t, g, unknown or other
tcagcgcagtacgacacgaccggtgctcgatttagatcacgtgcgtcgcggggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtcgtgggggagcgtggtccaggcctgggagtccctgagctctcctgtgtagcctctggattcaccttcagggtctatgacatgcacgtgggtcccnccaggcctccgaggcgaaggggctgggaggtgggtgctagtttanatccaaatgaatacggaaataaacaaatctatgtaacgactccggtaggaaacgggccgtaattcaacctatacctccaagagactaaacttacccaaagaactacgacgtagtactcgtgactacgatacgaacagcctagacgacgaccgaaagacggtacgggttatttaacgtacgtggtacgtacgtaaactttaaggtaaccgggaacggtaaccgtaaaccccgggtacccccgtacggaccgacggaccgg

SEQ ID NO: 373467 - DNA, 565 bp, Homo sapiens
  misc_feature: GZ8MTXP02FRHJC.52.83.H06.1.454.CMB.2.raw
  modified_base (308)..(308): a, c, t, g, unknown or other
  modified_base (354)..(354): a, c, t, g, unknown or other
  modified_base (420)..(420): a, c, t, g, unknown or other
  modified_base (425)..(425): a, c, t, g, unknown or other
  modified_base (436)..(436): a, c, t, g, unknown or other
  modified_base (450)..(450): a, c, t, g, unknown or other
  modified_base (458)..(458): a, c, t, g, unknown or other
  modified_base (465)..(465): a, c, t, g, unknown or other
  modified_base (499)..(499): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagctgggttttcctcgttgctcttttaagaggtgtccagtgtcaggtgcagatggtggagtcgtgggggaggcgtggtcagccgtgggagtccctgagactctccgtgtgtagcctctggattccaccgtttcaggttctatgaacatgcacgtcgggccnccaggcctccgagggcgaaggggctgggaggtggggtgctatttanatacaaatgaatggggaaataaacgaaatactatagtacgactcgtagaacggcattcacatccanacganacattaccaanactcgactgtactntcgacaantacgaanacgctacgaagcgaaccgaagtacgacgggtttnttaaactgtacgaagtacgtaaaacgttaacgtacggaaacggtaaccgaacccggttaacccccg

SEQ ID NO: 373468 - DNA, 620 bp, Homo sapiens
  misc_feature: GZ8MTXP02FGUQQ.52.83.H06.1.454.CMB.2.raw
  modified_base (304)..(304): a, c, t, g, unknown or other
  modified_base (354)..(354): a, c, t, g, unknown or other
  modified_base (424)..(424): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagcttgggttttcctcgttgctcttttaagaggtgtccagtgtcaggtgcagatggtggagtcgtgggggagcgtggtccagccgtgggagtccctgagactctctgtgtagcctcgtggattcaccttcaggtctatgacatgcacgtgggtcccnccgaggtcctaccgagggcgaaggggctgggagtggggtgccctatttanatacaaagtgagtggaaagtaaacaaatactatgtagactcgtagaacggcgtattcaccatctacaganaactaactaccaaagaaactacgatagtatctgacaacagtacgaaacagtacccgtagaacgacgaccggaaaacgaccgttaacgggggtttacgttttaaacgttaccgttaggtaacggtaacgttaaaaccgtttaaaacggtaccggggtaaaacggtaaacccgtaaaccccgggttaaacccccccgg

SEQ ID NO: 373469 - DNA, 631 bp, Homo sapiens
  misc_feature: GZ8MTXP02FPXL7.52.83.H06.1.454.CMB.2.raw
  modified_base (262)..(262): a, c, t, g, unknown or other
  modified_base (266)..(266): a, c, t, g, unknown or other
  modified_base (294)..(294): a, c, t, g, unknown or other
  modified_base (310)..(310): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagcttgggttttcctcgttgcttcttttaagaggtgtccagtgtcaggtgcagatgggtggagtcgtgggggagcgtggtccaggccgtgggacgtccctgagctctctgtgtancctntggtattcaccttgaggtctagtgaacntgcctacgtcggtccncccgtaggcctccgagggcgaagggggctagggagtggggtgacctatttatatacaaagtgatagggaaataaacaaatactataggtaacacgttaccgtaggaaacggtcgtaattacccactactcctaccgaagacaactaacttaacccaaagtaactacgtcttagtactacacgacaacgtatacgaacgtacgccgaggaacacggaaccgaaacggaacgtacgggtttagtttaactacgttacgaacgtaacgttaaacttaacggttaacggaaccggaaacccgtaaccccggggttaaaccccccg

SEQ ID NO: 373470 - DNA, 697 bp, Homo sapiens
  misc_feature: GZ8MTXP02JZK1O.52.83.H06.1.454.CMB.2.raw
  modified_base (161)..(161): a, c, t, g, unknown or other
  modified_base (314)..(314): a, c, t, g, unknown or other
  modified_base (367)..(367): a, c, t, g, unknown or other
tcagcgcagtacgacacgaccggtgctcgatttagatcacgtgcgtcgcggggagctctgggagaggagcccagcactagaagtcggcggtgtttccattcgctgatcagcactgaacacagaggactcaccatggagtttgggctgagctgggttttccncgttgcttcttttaagaggtgtccagtgtcaggtgcagatggtggagtcgtgggggagcgtggtccagccgtgggagtccctgacgactctccgtgtcgtacgcctcgtggattcacctttcagggtctatgacatcgacacgtggggtcccnccgaggcctccgagggcgaaggggctgggagtggggtgaccctatttagactnaaaagtgaactgggaaaataaccaaaagtctatacggtaaagtaccctaccggtaggaaaccgggtccgtaactttaacccaacccgtaagttcccgtaacccaaagggtaacgaaaaccttaaaacggtttaccaaaacccggtaaaattaaacccggttacgttacgttaacttccgtacgtaaccctaaacgaacgtaacgaaacgaacgacgtaacgtaacggacggaacgaaacggtaacgtaacggttacgttaacgttaacgttacgtaacgtacgtaaacgttaacgtaacggtaacggtaaccgtaacccggtaaccccgg

SEQ ID NO: 373471 - DNA, 558 bp, Homo sapiens
  misc_feature: GZ8MTXP02F8SU7.52.22.B11.1.454.CMB.2.raw
  modified_base (218)..(218): a, c, t, g, unknown or other
  modified_base (503)..(503): a, c, t, g, unknown or other
tcagcgcagtacgacacgaccggtgctcgatttagacgacagctcagggcacgaccggtgctcgatttagatcgtctgtgttgggtttgggggaggcttggtaaagcgggggggtatctgagactctcctgttcagtctctggattcaccttaaataactatggcatgagctgggtccgccaggctccagggaaggggctggagtgggtctcatttancagtggtactggtggtagcacatactacgcagactccgtgaagggccgttcaccatctccaaagacaattccaagaacacgctgtatttacaaatgaacagcctgagagccgaggacacggccgtatatactgtgtgaaagatctccacgtctccgcccccttggacttgttatttcgactcctggggccagggaaccctagtacgcccgtctcctcacgcctccaccaaacgggcccagtccggtccttccccctggccacccctcctccaagacgcacctcgnggggcacgcgccgcccgtggctcgccgtggtcaaggactacttctactacgatcg

SEQ ID NO: 373472 - DNA, 594 bp, Homo sapiens
  misc_feature: GZ8MTXP02GQEGT.52.22.B11.1.454.CMB.2.raw
  modified_base (219)..(219): a, c, t, g, unknown or other
  modified_base (357)..(357): a, c, t, g, unknown or other
tcagcgcagtacgacacgaccggtgctcgatttagacgacagctcagggcacgaccggtgctcgatttagatcgtctgtgttgggtttggggaggcttggtaaagcgggggggtatctgagactctcctgttcagtctctggattcaccttaaataactatggcatgagctgggtccgccaggctccgaggggaaggggctggagtgggtctcatttancagtggtactggtggtagcacatactacgcagactccgtgaagggccggtcaccatctccaaagacaatccaagaacacgctgtatttacaaatgaacagcctagagagaccgaggacacggccgtatatactgtgtnaagatctccacgtctccgccccctggactgttattcgactccgtgggccaggaccctagacgccgtctcctcacgcctacccaccaacgggcccagtcccggtccctttcccccgacggtcccacccccgttcctcccgaagacgccaccctcgtcgggggaccaccgcgcccgggcccttcgggcctcggtcccgtggtcaaacgggacttacgttccctacgttaacgactccgg

SEQ ID NO: 373473 - DNA, 589 bp, Homo sapiens
  misc_feature: GZ8MTXP02GC6QU.52.22.B11.1.454.CMB.2.raw
  modified_base (180)..(180): a, c, t, g, unknown or other
  modified_base (220)..(220): a, c, t, g, unknown or other
  modified_base (364)..(364): a, c, t, g, unknown or other
tcagcgcagtacgacacgaccggtgctcgatttagacgacagctcagggcacgaccggtgctcgatttagatcgtctgtgttgggtttgggggaggcttggtaaaggcgggggggtatctgagactctcctgttcagtctctggattcaccttaaataactatggcatgagctgggtccnccaggctccgagggaaggggctggagtgggtctcatttancagtggtactggtggtagcacatactacgcagactccgtgaagggccgttcaccatctaccaaagacaattccaagaacacgctgtatttacaaatgaacagcctgagagccgaggacacggccgtatatactgtgtagaaagntcctcacgtctccgtcccccttgacttgttattcgactccgtcgggccacggaaccctagtacgccgtctcctcacgcctaccaaccgaacgggcccagtccggtcccttcccccgtggccctaccccgtccctacgaacgacgccacccgtcgtcgggggccaccgcgccggcccgtcggcctcgccgtggaaccgaaggtacctacttccgtactacgatccg

SEQ ID NO: 373474 - DNA, 677 bp, Homo sapiens
  misc_feature: GZ8MTXP01EI9TZ.3.52.E08.1.454.CMB.2.raw
tcagagacgcactccacgaccggtgctcgatttagtcgagctctctcggcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtgggaggaggcttggatccgagccgtggggggtccctgagactctcctgtgcgacgcctcgtcggtccttccgaccgtcgagtacgcacgactacagtcgcctacggtcgggccccgaccgaggccctaccgggaagggggacggggtcgtgggtaggttcgggtactacgttaagtttaacttaactactttcgacgtaaccactactaaacctacctcccggtacccgtagggaacgggtacctaacttaaccacgttaccaccgaagacgtaacgacgttacccggaaagtaaacgtcgggttatactacgttaacaaagtacgaaacctacggagaacgacgaccgacgaaccgtacgttctttaatcgtgacgagaagaacgtagttcgggaggtttcgggtccggtaaccttccgttccgtttcggttcttacgtcgtactcggttcggtcgggggttcctcgg

SEQ ID NO: 373475 - DNA, 577 bp, Homo sapiens
  misc_feature: GZ8MTXP01AFZ8H.3.52.E08.1.454.CMB.2.raw
  modified_base (292)..(292): a, c, t, g, unknown or other
tcagagacgcactccacgaccggtgctcgatttagtcgagctctctcggcgggggcaggagtcagacccagtcaggacacagcatggacatgagggtccccgctcagctcctggggctcctgctgctctggttcccaggttccagatggcgacatccagatgacccagtcctccatcctccgtgtctgcatcgtggtagggggacaggagtcgctatgacttggcgggcgacgttcggtcggttttaacaggtattggttagtctggtatcagacagaaaaccagggaaacncccctgacttcctgatgtctgctgcactccaccctgactaaagtcgagtcccatccagtatcagcgtacaaggtgaaagtcgtaggggacaggacgttcactctacactatcagcagcctgcagacctagaacgtatttacgacttaacgttactattgtacaacgtaggtctacgaactcgtcctcccgtcttccgtaccgtttcggggaccgggtaacgggaacccgttaaggggttacggaacgtaagtaaccgtaaaacggaccgttggtcgggctaacgg

SEQ ID NO: 373476 - DNA, 647 bp, Homo sapiens
  misc_feature: GZ8MTXP01DRUNI.3.52.E08.1.454.CMB.2.raw
tcagagacgcactccacgaccggtgctcgatttagtcgagctctctcggcgggggggagaggagcccagcactgggattccgaggtgtttccattcggtgatcagcactgaacacagaggactcaccatggagttttggctgagctgggttttccttgttgctatttcaaaaggtgtccagtgtgaggtgcgaggtggtggagacgtggaggaggcttgatccagccgtgggggtccctgagactctcctgtgcagcctctggcttcaccgtcagtagcagctacatgcacgtcgggtcccgccaggcctccgaagggggagggggctgggaggtggggtcttcgtaagtttatttaacgaacttcgtaggtaacccaactaactaaacccttaaccctccccggaaccccgttagggaaacggggtccctaaattaacccatcctaccaagaacggtaacgacttacccgaagaaactcgggtatactcttacaaaatcgaaaccaaccgtgaacgacgaccgacgaaccacgggttcctttaaattcgtagtgaccgagtaagtattcggaggttcgggtccgggtacccttcgcccgtttggtttcaccgtttcgacttcgttcggtccgggggttccgtcggg

SEQ ID NO: 373477 - DNA, 576 bp, Homo sapiens
  misc_feature: GZ8MTXP01AT7KU.3.52.E08.1.454.CMB.2.raw
  modified_base (278)..(278): a, c, t, g, unknown or other
tcagagacgcactccacgaccggtgctcgatttagtcgagctctctcggcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgtacggttttaacagtatggttagtctggtatcagcaagaaaccgagggaaacncccctgacgttcctgatgtctgctgcactcccacctgacaaagtcggacgtcccatccagattcgagcgtcaagtgaatcgtgggacagagttcactctcacatcagcagcctgcacgcctagaacgtatttgacttaaacttactatttacgacaaacgacggcttacggaactccgttccctccccggtacttccgtaaccggtttccggggacggaacggggaacccgaaggggttacgggaagacgttaaccgaaaaccggtaacgttggacgggttcctcgaaccgtaacccg

SEQ ID NO: 373478 - DNA, 647 bp, Homo sapiens
  misc_feature: GZ8MTXP01EG8W0.3.52.E08.1.454.CMB.2.raw
  modified_base (467)..(467): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcacgcctctggcttcaccgtcagtgcagctacatgcacgtcgggtccgcgaggcctccgagggggacggggctgggagtgggtctacgtagttattacgtaacttcgtacggtaccactactaaacctacccgtcccggaccccggtaggaacggggaccctaacttaaccagttcctaccaagacgacgacttaccggaagtaaaccgtacggtntactaccttagaaatagaaaccaacggtggaagacgacccgtacgaacgaccgggttactttaacgtacgtggtacgacgaaggtaagtcgtttcgggaaggtttcgggtaccggggtaacccttcgttaccccgttgggttaacctacgttcgtctcgttcggtcggggccgtaacggg

SEQ ID NO: 373479 - DNA, 688 bp, Homo sapiens
  misc_feature: GZ8MTXP01BOBTG.3.52.E08.1.454.CMB.2.raw
  modified_base (237)..(237): a, c, t, g, unknown or other
  modified_base (493)..(493): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtggaggagcttgatccagccgtgggggtccngagactctcctgtcgcacgtcctcgtcggtccttcaccgtcagtagcagctacatcgcacgtcggtccgccaggcctaccggagggggaacgggcgtgggaggtgggtcttacgtaagtttactttactaacgtttcgtacggtaacccaactaacttaaaccctacccgtccccggaacccgtagggaaacgggtaccgtaacttaaccgactcctaccgaagaacgacgtacgttaccgaagaaccgtacggtntaactacttaacaaagtacgaaaccaaccgtagaacgacggacccgaacgtaccgtacggtcctttaataccgtgtacggcgaagtaacgtaacgttcggtacggggttcgggtacccggggacccttccgttccccggttggttcccttaacgttccgtacgtccggttcggtcgggggttcccgttcccgggg

SEQ ID NO: 373480 - DNA, 694 bp, Homo sapiens
  misc_feature: GZ8MTXP01AO481.3.52.E08.1.454.CMB.2.raw
tcagagacgcactccacgaccggtgctcgatttagtcgagctctctcggcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtgggaggaggcttgatccgaggccgtcggggggtcctgacgactctcctgtgcacgcctcgtcggtcttcgaccgtcagtacgcagctacatcgctacgtcgggtcccgccgaggccgtaccggaagggggaacgggggtcgtggggaggttcggggttcttacgtaagtttactttaactaacttcgtacggtaacccactactaacctaccgtcccgacccgtaggaacgggccgtaacttaaccatccaccgaagacgacgtacttaccggaaagtaaaccgtggttataactaccttaaacaaaagtacgtaaaaccaaccggttggaaacggaccgaaccccggaacgaaccgtaccggttaccgtttttaaactaccgtggtacgcgaagtaacggttacgtttcgggaagggtttcggggttacccgggacccttcgttcccgttggtcctacgttcgactcgttcggtcggggccgtcg

SEQ ID NO: 373481 - DNA, 801 bp, Homo sapiens
  misc_feature: GZ8MTXP01ASB5Z.3.52.E08.1.454.CMB.2.raw
  modified_base (640)..(640): a, c, t, g, unknown or other
  modified_base (702)..(702): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggtagttttggctgagtcgttgggttttccttgttgtcttatttacgaaaaggtgtccagtgtgaggtgcgagggtggtggagacgtggaggaggtcttagactccgacggtccggtcgggggtccctaggacgtacctcctccgtggtcgccgacgtcccttcgtcggtccttaccgaccgttcgaagtacgacacgtacctacgagtcgccgtacggtccggggtccccgacgacgggtccgtacgggggaagggggtacggggtcggtaggggtacggtttcgggttaccttacgttaagttttaactttaacgttaaccgtttccggtacggtaaccctaacgtaacccgttaaacccgttaccccgtaaccccggtaaacccgggtaagggtaaacccgggtacccgtaaaccttaaccacttacccgtaacccgaaggtaaccgtaaccgtaccgttaaccggaaagtaaacccggttaggttactaacctacttaaaacgaaanaacggtaaacccaacggggtacgaacggaccgaccggaaaccgtcgtaaccggttctttaancgtggtacgaggtagtgtacggttcggacggttccgggtaccggtaccttccggttcgtttcgtcgttactcggtcgtcgttcggggtcggttccgtcg

SEQ ID NO: 373482 - DNA, 670 bp, Homo sapiens
  misc_feature: GZ8MTXP01CV63Y.3.52.E08.1.454.CMB.2.raw
  modified_base (287)..(287): a, c, t, g, unknown or other
  modified_base (505)..(505): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccgagccgtgggggtccctgagactctcctgtgcagcctcgtcggtcttcaccgtcagtagcagctanatcgcacgtgggtcccgccgaggcctccggaagggggacggggcgtagggaggtcgggtctacgtaaggtttatttaactaactttcgtacggtaccaactacttaaacccttaaccgtcccggtaacccccgtagggaaacgggtaccgtaacttaaacccacttccgaccaaggtacgaacgtacttaccgaagaacgtacgttagtatacttaanaaatacgaaaccacgtaggaacgaccgaccggaacgaccgtaccggttctttaagttccgtgtacgacggaagtaagtagttcggacggttcgggttacccggggtccttccgttcccggttgttccttacgttcgacgttccggttcggtcgggggccgtccgg

SEQ ID NO: 373483 - DNA, 670 bp, Homo sapiens
  misc_feature: GZ8MTXP01CIKMT.3.52.E08.1.454.CMB.2.raw
  modified_base (321)..(321): a, c, t, g, unknown or other
  modified_base (445)..(445): a, c, t, g, unknown or other
tcagagacgcactccacgaccggtgctcgatttagtcgagctctctcggcggggggggagaggagcccagcactgggattccgaggtgtttccattcggtgatcagcactgaacacagaggactcaccatggtagttttggctgagtcttgggtttttccttgttgcttatttacaaaaggtgtccagtgtgaggtgcgaggtggtggagacgtggaggaggtctgactccgagccggtgggggtcctgacgactctcctgtcgcacgtcctcgtcggtccttccgaccgtcagtgcagctacatcgcacgtcgggtcccnccgaggccgtaccggaagggggacgggcgtgggtaggtcggtactacgtagtttacttaactaccgttcgtacggtaaccactactaacctaccgtcccgaccgtagacgggtacacttaaccntactacgagacgacgtagttaccgaagtaaccgtaggtacgtactacgtaactaaatacgaaacctaacgtaggaacgtaccgacccgaacgtaaccgtaccggttactttacgtacgtggtacgtacgaaggtaagtacgttacgggtacggttcgggtacccgggtccttaccgttccggttacgttcctcgtcgtacgttccgttcgggtcgggccgtccgg

SEQ ID NO: 373484 - DNA, 786 bp, Homo sapiens
  misc_feature: GZ8MTXP01ALU6G.3.52.E08.1.454.CMB.2.raw
tcagagacgcactccacgaccggtgctcgatttagtcgagctctctcggcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccgagccgtggggggtccctgagactctcctgtgcagcctcgtcggcttcgaccgtcgagtagcagctacagtcgcacgtcgggtcccgccgaggcctaccggaaggggggaacgggggcgtggggaggttcgggggtccttacgtaaggtttaactttaacgaaacgtttcctacgggtaaccctaactaacttaaaccttacccgtccccggtaccccgggtagggtaaacgggtcccgtaaactttaccacgtccctacgaacggaacgtaccgtaacgttacccgaaaggtaacccgtacggggtaacgttactacccgtttaaaagaaaacgtacgaaaaccgtaaccggggtaggaaccggaaccggtaacccggtaaaccgtaacggttacccggttaccgttttaacgtacgtagggtacggacggtaaaggtaacggttaacggttacgggtacggggtttcccggggtacccgggtacccttcccggttcccgttttcgggttaaccgtaccgttcgttaccgttccggttaccggggtccggggttcccggtccg

SEQ ID NO: 373485 - DNA, 694 bp, Homo sapiens
  misc_feature: GZ8MTXP01EE1J2.3.52.E08.1.454.CMB.2.raw
  modified_base (306)..(306): a, c, t, g, unknown or other
  modified_base (490)..(490): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggtagttttggctgagtcttgggtttttccttgttgcttatttacaaaaggtgtccagtgtgaggtgcgaggtggtggagacgtgggaggaggcttgactccgagccggtgggggtcctgagcctctcctgtgcacgtcctcgtcggtccttccgaccgtcaagtacgcacgtctanagtcgaccgtacggtcggggtccccgccgacgggtccgtaccgggaagggggtaacgggggtcgtaggggtacggttcgggtacttacgttaagtttactttaaccgtaactttcgtacggtaaccactaactaaacccgtacccgtcccggacccggtaggaaccggaccgtaacttaacccnttccgaccaaggaacgacgtacgtacgaagtaaccgttgtaatctacaaacgaacgtacgaaacctacgggtaagaaccggaccacccggtaacacccggtacgtttaccttaatacgtggtagaacgagtaagttcgttagggtacggttcgggaccgtaccttcgttcgttcttctacgtgtctcggttcgggtcgccggtc

SEQ ID NO: 373486 - DNA, 702 bp, Homo sapiens
  misc_feature: GZ8MTXP01DT2YB.3.52.E08.1.454.CMB.2.raw
  modified_base (293)..(293): a, c, t, g, unknown or other
tcagagacgcactccacgaccggtgctcgatttagtcgagctctctcggcgggggggagaggagcccagcactgggattccgaggttgtttccattcggtgatcagcactgaacacagaggactcaccatggagttttggctgagtcttgggttttccttgttgctatttacaaaggtgtccagtgtgaggtgcgaggtggtggagacgtggaggaggcttgatccgagccgtgggggtccctagacgtactctccgtgtcgacacgtcctgtcggcttcaccgtcaggtacncagctacgatcgcacgtcgggtccgccgaggccgtacggaagggggacgggtcgtagggtacggtggtctacgtagttaattactattcgtagtaccacgtactaacctactcccggaccgtaggaaacgggtcctaacgtaactacgttcacccgaagtacgtaaccgagttacccgaaggtaaaccacgggtttataactaccgttaacaaaagttacgaaacaccgggtaagacgacggacccgacgaaccgtcggttacgtttaaagttcgtgggtacgccggtaagaacggttacgttaacggggtcgggttccggggttaacccgggtaccttacccggttcgtttccggggttaactcggttaaccgtacgtcccggttggttcgggggaacccgttccggg

SEQ ID NO: 373487 - DNA, 711 bp, Homo sapiens
  misc_feature: GZ8MTXP01B45UU.3.52.E08.1.454.CMB.2.raw
  modified_base (273)..(273): a, c, t, g, unknown or other
  modified_base (620)..(620): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagtctgggttttccttgttgctatttcaaaaggtgtccagtgtgaggtgcaggtggtggagacgtggaggaggcttgatccagccgtgggggtccctgagactctcctgtgcagcctctggcttcaccgtnagtagcagctacatcgcacgtcgggtcccgccgaggccgtaccggaagggggtaacgggggcgtgggggaggttcgggggttcttcgtaaggtttatttaacgtaaacgtttcctaggtaacccactacttaaaccttacccgtcccggtacccccgtagggaaaccggggacccgtaacgttaaaccccattaccctacccgaaggaacggtaaccgtacttacccggaagaaacccgtagggtacttactacttaacaaatacgaaacctaaccgtggaacggaccgacccggtaaccgaaccgtccgggtacccttttataccgttggcgtacggaggaacgtntttacggggaggttcggggttaccgggtacccttcggttaccccgttggttaaccctaccgtgtactcgttcgggtcggggttcccgtcgg

SEQ ID NO: 373488 - DNA, 711 bp, Homo sapiens
  misc_feature: GZ8MTXP01CYJ4D.3.52.E08.1.454.CMB.2.raw
  modified_base (272)..(272): a, c, t, g, unknown or other
  modified_base (301)..(301): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccgagccgtgggggtccctgagactctcctgtgcagcctcgtggcttcaccgtnagtagcagactacatcgcacgtgggtccnccaggcctaccggaaggggacgggctgggagtcgggtcttcgtagtttattacgaactttcgtacggtaccaacgtactaaacccttaccgtcccggaaccccgtagggaaacggggtcctaacttaaccactcctaccgagtaacgacgtacttacccggaagtaacgtacggttagttaactacttaacaaactaacggaaaccctaaacggttacggaacggtaaaccgacccgaaacggtaccgtaaccgggttcccgtttttaaagtaaccttggtacggtaccgttaaggaaacggttacgttaccgggtaagggttcggggtttaacccggggaccttaccgttccgtttacgggtttcctaacgtttcgaacgttccgttcgggttccggggccggttcccg

SEQ ID NO: 373489 - DNA, 641 bp, Homo sapiens
  misc_feature: GZ8MTXP01DSB3B.3.52.E08.1.454.CMB.2.raw
tcagagacgcactccacgaccggtgctcgatttagtcgagctctctcggcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcacgcctcgtcggcttcaccgtcagtagcagctacatgcacgtcgggtcccgccaggcctaccggaagggggaagggggcgtgggaggtggggtcttcgtagtttatttactaacttctacggtaccactactaacctacctcccgacccgtaggaaacgggaccgtaacttaaccatcctaccaagagacgacttaccgaagaaacgtcggtatactcttaacaaatagaaaccaacgtagagacgccgaacgaccgacggttccgtttaacttagtggtacggacgaggtaagtcgttcgggaggttcggggttacccggggaccttaccgttccgtttcggttccttacgttcgtacgttcgttcgggtcgggggttccgttccgg

SEQ ID NO: 373490 - DNA, 738 bp, Homo sapiens
  misc_feature: GZ8MTXP01AD7ZB.3.52.E08.1.454.CMB.2.raw
  modified_base (445)..(445): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagcgtggtttcctgttgctattcaaaggtgtccagtgtgaggtgcaggtggtggagacgtggaggagcttgatccagccgtggggggtccctgacgtactctcctgtgcacgcctctggcttacgaccgtcagtagcagctacatgctacgtgggtccccgcgacggccgtaccggaagggggaacgggggctggggaggtcgggtacttacgtagtttactttacaacctttcgtacggtaaccactacttaaaccctacccgtaacccgacccggtacggaacggggtacctaactaaccncttccggaccaaggacgtacgtaacgttacccggaacgaaacgtccgggtttataacttacttaccgtaaaagtacgtaaaccacggggtgaaaacggccttacccgggaaacgttcgaaccgggtttaccttttaagtaccggtcggtacgaacggtaaggtcggttacggttaccgggtacgggttccgggggttacccggtaaccccttcccgttacggtttaccgggtttaaccgttaccggttccgtacggttcccgggttaccggggtcccggggttcccgtaacgg

SEQ ID NO: 373491 - DNA, 688 bp, Homo sapiens
  misc_feature: GZ8MTXP01ENUTC.3.52.E08.1.454.CMB.2.raw
  modified_base (526)..(526): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccgagccgtgggggtcctgagactctcctgtgcacgcctcgtcggtcttcaccgtcagtagcagctacatcgcacgtcgggtcccgccgacggccgtaccggaagggggaacgggggtcgtggggtagggttcgggtcttacgtaagtttactttaactaacttcgtacgtaaccaactacttaaacccgaccgtcccgacccggtaggaacgggtccgtaacttaaccacttccacaagacgtacgtatacccgaaagaacgtcggttatactaccttaacgaaatacgaaacctaacggggngaacggaccacccggaaacgaccgtaccggtttacgtttaatccggtgtacgaccggaagtaagtcggttacgaacgggtttcggggttacccggtaccttcccggttacccgtttggtccccttagtaaccgtgttcgttccgggtgggggttcccctcgg

SEQ ID NO: 373492 - DNA, 899 bp, Homo sapiens
  misc_feature: GZ8MTXP01B8N6V.3.52.E08.1.454.CMB.2.raw
tcagagacgcactccacgaccggtgctcgatttagtcgagctctctcggcgggggggagaggagcccagcactgggattccgaggtgtttccattcggtgatcagcactgaacacagaggactcaccatggagttttggctgagtctgggttttccttgttgctatttcaaaggtgtccagtgtgaggtgcaggtggtggagacgtggaggaggcttgatccgagccgtgggggtccctgacgactctcctgtgcacgcctctggcttcaccgtcagtagcagctacatgctacgtcgggtccgccgaggcgtcccggaagggggaacgggggtccgtggggaggttggggtacctagtagtttaactttaaccgtaaacgtttccgtacgggtaaccctaacgtaacttaaacccgttaacccgttccccgggtaaacccccgggttagggtaaacccgggggtacccgtaaaccttttaaaccccgtaacgttaccccgttaaccccgtaaagggaaccggtaaacccggttaaccgtttaaccccgggaaaacgggtaaaacccgggtaccgggggtttaacgtttaaaccgtttaaccccgtttaaacaaaaaaacgtttacccggggaaaaaaccccttaaaccccggggttaggggtaaaacccgggtaacccgggtaacccccgggaaaccggttaaccccgtaacccgggggttaccccgtttttaaaggtaccgttacgggtacggtaccggtaaaggtaacgtacgtttacgggtaacgggttccggggttaccgggggtaccccttccgttaaccccggttgggtttaaccctaaccggtttcggtaacgttccccgttacggggtcccgggggttcccgtcccgggg

SEQ ID NO: 373493 - DNA, 654 bp, Homo sapiens
  misc_feature: GZ8MTXP01DW4BX.3.52.E08.1.454.CMB.2.raw
tcagagacgcactccacgaccggtgctcgatttagtcgagctctctcggcgggggagtcagacccagtcaggacacagcatggacatgagggtccccgctcagctcctggggctcctgctgctctggttcccaggttccagatgcgacatccagatgacccagtctccatcctccgtgtctgcatcgtggtaggggacagagtcgctatgtacgttggtcgggcgtacgtcggtacggttttaacagtagttgggttagtcgtaggtatcgaagacaaggaaaaccgagggaaacgcccctagacgttcctgtatgtctgctcgcactcccacctgacgaaaggtcgactcccatccagacttcgagtcgtacgtaacgtagtaacgtcgtaggggaactagtacgttcactctacacccatcgacgcacgcctagcgacgtcctaagtaattacttttacgaacctttaaatttaccgttaatttaccgaacaaacgtacggtactacggaaacccttcggttccccttacccgtccttaaggttaaccccgggttacgggggaccgggaaacgggtaaacccgtaaaggggttcggaaacgttaacgtaaaccgaaacggtaagtcgggtacggcttaacgaaccctaaccg

SEQ ID NO: 373494 - DNA, 658 bp, Homo sapiens
  misc_feature: GZ8MTXP01AZ68U.3.52.E08.1.454.CMB.2.raw
  modified_base (283)..(283): a, c, t, g, unknown or other
  modified_base (634)..(634): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagcgtggtttcgtgtagctattacaaaaggtgtccagtgtgaggtgcgaggtggtggagagtggaggaggcttgatcagccgtgggggtcctgagctctctgtgcagtccctgtggcttcgacctgagtagcagcctaacntcgcgtacgtcggccgcgacggtcgtacggagggagggtcgtgggtacggtcggtactagttaagtttaacttaacgtaccgttcgtacgtaaccactactaaccgtacccgtcccgaccggtacgaaccggtaccgtaactaaccactacgtacgagacgtacgtacgtaccgaagtaaccgtagttataacctacgtaaactaaacgtacgaaaccacggtagaacgtaccgaaccgtacgtaaccgtaccggttactttactacgtggtacgacggaaggtaagtcggttacggtacgggttccgggtaacccggtccttaccgttccgtttgttaaccctacgttcncgttcggttcggtccgggccgtcg

SEQ ID NO: 373495 - DNA, 658 bp, Homo sapiens
  misc_feature: GZ8MTXP01D39ZN.3.52.E08.1.454.CMB.2.raw
tcagagacgcactccacgaccggtgctcgatttagtcgagctctctcggcgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcgaggtggtggagacgtggaggaggcttgatccagccgtgggggtcctgacgactctccgtgtgcacgtcctcgtcggtcttccgaccgtcagtacgcagctacatcgcacgtcgggtcccgcgaggcctaccggaagggggacgggggcgtgggtaggtcgggtctacgtagtttacttactacttcgtacgtacctacactaacctacctcccggacccgtaggaaacgggtaccgtaactaaccactcctaccgaagacacgacttcgaagtaaacgcggttatactacttaacaaattacgaaactacgtagacgacgaccgaacgacgtaccgtacgtttaactgtcgtcggacgagtaagtgttccgggtaggttcggggttacccggggtaccttacccgttccgttcggttccttacgttccgtacgtccggttccgggtcggggttcccgttccgg

SEQ ID NO: 373496 - DNA, 768 bp, Homo sapiens
  misc_feature: GZ8MTXP01DBBSO.3.52.E08.1.454.CMB.2.raw
tcagagacgcactccacgaccggtgctcgatttagtcgagctctctcggcgggggggagaggagcccagcactgggattccgaggtgtttccattcggtgatcagcactgaacacagaggactcaccatggtagttttggctgagtcttgggttttccttgttgcttatttacaaaaggtgtcagtgtgaggtgcgaggtggtggagacgtggaggaggtcttgatccgaggccggtcgggggtccctgacgactctccgtgtcgcacgccctcgtcggtcttccgaccgtcaagtacgcagactacagtcgactacgtcgggtcccgccgacgggccgtaccgggaaggggggaacggggtcgttagggggtacggttcggggttaccttacgttaaaggttttaaactttaacctaacgtttccgtaacggtaaccctaaactacttaaaacccgttacccgtccccggtaaccccggttaggaaacggggtaccctaaacttaaacctactacctacgaacggaacgtacgtaacgttacccggaagtaaacgtacgggttataacttacttaaacaaaacgtacgaaaccgtaacggtggaacgaccgaccgaaccgtaaccgtaccgttaaccgttttactaacgtggtacgacggaaggtaacgtacgttcgggtacgggttccgggttaccggggaccccttaccgttaccggtttcgttaacctacgttcgtactcggttaccggtcgggccgtcccggg

SEQ ID NO: 373497 - DNA, 655 bp, Homo sapiens
  misc_feature: GZ8MTXP01AGF26.3.52.E08.1.454.CMB.2.raw
  modified_base (473)..(473): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccagccgtgggggtccctgagactctcctgtgcagcctcgtggccttcaccgtcagtacgcagctacatgcacgtcgggtccgccgaggcctaccggaagggggaacgggggcgtgggagtcgggtctactagttatttacaacttctaggtacccactataacctactcccgacccgtaggaacgggccgtaattaaccacttcctacccaaggacgaacgtacttacccggaagtaaccgtacggggtntaacttcctaacaaaatcgaaacaaccggtgaacgcgaccgagaccgacggtctttatacgtggtacgcgagtaagtgttcggacgggttcgggtacccggggacccttaccggttccccgtttgggttcccttaacgttcggtacgttcccggttacggtccgggggttcccgtaaccggg

SEQ ID NO: 373498 - DNA, 808 bp, Homo sapiens
  misc_feature: GZ8MTXP01A4LSO.3.52.E08.1.454.CMB.2.raw
tcagagacgcactccacgaccggtgctcgatttagtcgagctctcccgcggggctgggagaggagcccagcactgggattccgaggtgtttccattcggtgatcagcactgaacacagaggactcaccatggagttttggctgagtcttgggttttccttgttgctatttcaaaaggtgtccagtgtgaggtgcgaggtggtggagacgtgggaggaggcttgactccgaggccgtcgggggggtcccctggacgtacctcgtccgtgtgcacgtcctcgtggtccttcaccgtcagtacgcacgctacatcgaccgtacgtcggggtcccgccgaacggccgtaccggagggggacgggcgtgggtaggtcggtactgtaagtttattacctaagttcgtacggtacccaactaacttaacccgtaaccgtaccccgggtacccggtagggaaaccgggtaccgtaaacgttaaacccacgttccgtaaccgaaaggtacgaaccgttaacgttacccgggaaacgtaaaccgtacggttacgtacttaccttaaactaaaacgtaccggaaaaccgtaacccggagggaacgaacccgggaacccgtaaccgggtaacctaaccgggggtttacccttttaagttaaacccgttgggtaacggaccgtaaagggtaaggtttccgggttacggggttaaggggtttcccgggggttaacccgggaacccttccggttaccccggtttaagtttccccgtaattttacccgggctttccgggttccgggggttccgggggttccccg

SEQ ID NO: 373499 - DNA, 874 bp, Homo sapiens
  misc_feature: GZ8MTXP01DP6BL.3.52.E08.1.454.CMB.2.raw
tcagagacgcactccacgaccggtgctcgatttagtcgagctctctcggcggggggggagaggagcccagcactgggattccgaggtgtttccattcggtgatcagcactgaacacagaggactcaccatggtagttttggctgagtcttgggtttttccttgttgtcttatttacgaaaaggtgtccagtgtgaggtgcgaggtggtggagacgtggaggaggcttgatccgagccgtgggggtccctgacgactctcctgtgcacgcctcgtcggtctcgaccgtcagtagcagactacatcgcgtacgtcgggtcccgaccgacggccgtaccgggaagggggtaacgggggtcgtagggggtacggttcgggggttaccttacgttaaggtttaaactttaccgtaaacgtttccgttaacggtaaccctaactaaccgttaaacccttaacccgtaacccccgggtaaccccgtaaggggtaaacccggggtaccccgtaaaacttaaccccgacttacccgtaaccgaacggtaaccggtaaccggtaacgttacccggaaaacgtaaacccggtttacgggttaacgttaacctttaaccgttaaactaaaaacggttaacgaaaaaccccgttaaacgggttaacggaaacggtaaccggtaacccggtaaaccgtaaccggttacccggtttaaccgtttttaagtaccgttgggtaaccggaacggtaagggtaaacggttcgggtttacgggtaaccgggggtttccgggttaaaccccgggtcccttacccggtttaccgttcgggttttaacctaccgtttcgtacgtccgttacgggggtccgggttaacccgtcccggg

SEQ ID NO: 373500 - DNA, 725 bp, Homo sapiens
  misc_feature: GZ8MTXP01EPL6Q.3.52.E08.1.454.CMB.2.raw
  modified_base (273)..(273): a, c, t, g, unknown or other
  modified_base (307)..(307): a, c, t, g, unknown or other
  modified_base (535)..(535): a, c, t, g, unknown or other
  modified_base (616)..(616): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggtagttttggctgagtcttgggttttccttgttgcttatttacaaaggtgtccagtgtgaggtgcgtagggtggtggagacgtggaggaggtcttgactccgacggtccggttcggggggtccctgacgtacctctccgtgtncacgtcctcgtcggtccttccgaccgtacagtanacagtctacagtcgacctacggttccggccgaccgacggccgtaccggaagggggaacgggtcgttgggtacggttacgggtccttacgtaacgtttacttacgtaacccgtttcgtaacgtacctacgtaacttaaccctacccgtcccgtacccgtaggaacgggtaccttaaactaaccgataccgtccgaagtacgagtacttaccggaagtaacgtacggttntaaccttctaaacaaattacgaaacctacggtgaacgacgacccaacgtaccgtaaccgttagtttactaccgtgtacggntaaggtaacgtcgttacgggtaggttccggggttacccggtaaccttccggttaccgtttcggtaacccttctaacggtctccggttacgggtccgggttcgttcccgg

SEQ ID NO: 373501 - DNA, 670 bp, Homo sapiens
  misc_feature: GZ8MTXP01DRJ5V.3.52.E08.1.454.CMB.2.raw
  modified_base (253)..(253): a, c, t, g, unknown or other
  modified_base (264)..(264): a, c, t, g, unknown or other
  modified_base (296)..(296): a, c, t, g, unknown or other
  modified_base (320)..(320): a, c, t, g, unknown or other
  modified_base (399)..(399): a, c, t, g, unknown or other
  modified_base (484)..(484): a, c, t, g, unknown or other
tcagagacgcactccacgaccggtgctcgatttagtcgagctctctcggcgggggcaggagtcagacccagtcaggacacagcatggacatggacgggtccccgctcagctccgtggggctcctgctgctctggttcccaggttccagatgcgacatccagatcgacccagtcctccacttccctccgtgtctgctagtcgtggtagggacagacgtcgactatgtacgttgcgggcacttcgtagtttaaangtagtggttanctggtatcgagcgaagtaaccgaggggaaccnccccttagacgtttccagatcgtntcgctcggcctagtacccccgacttcggaaacgtaaaggttcgggaacctacccctacgtacccgtaggtacttaacgnggttaaccgtacgaagtttcgaaactcgggacggggtaactacgggtacttccaccttaccaccaaccggataccgagaaccccngggtcccgacgacgacgtcgtaagttaacgtttacgttacgtaaacttacttacgtacgtacgtaacgacgtacgtctcggtacctcgtcccgtaacgtcgttaccggttacgggttacggacgggtaacggttacggttaggacggtaagtaaccgtaacgaacggttcgttacggtcgttctcg

SEQ ID NO: 373502 - DNA, 809 bp, Homo sapiens
  misc_feature: GZ8MTXP01AOLPR.3.52.E08.1.454.CMB.2.raw
  modified_base (682)..(682): a, c, t, g, unknown or other
tcagagacgcactccacgaccggtgctcgatttagtcgagctctctcggcggggggggagaggagcccagcactgggattccgaggtgtttccattcggtgatcagcaccgaacacagaggactcaccatggagttttggctgagcttgggttttccttgttgcttatttacaaaaggtgtccagtgtgaggtgcgaggtggtggagacgtgggaggaggtcttgactccgacggtccggtgggggtccctgacgtctctctgtcgcacgtcctcgtggtccttaccgaccgtcagtacgcagtctacagtcgcgacggttccgggcccgaccgacggccgtacgggaagggggtacgggtcggtggggtagggttcgggttacttacgttaacgtttaactttacgtaaacgttttcccggttaacggtaacctaacgtaaccttacccgttaaacccggtaccccggtaaccccgggtaggtaaacccggggtacccttaaaccggttaacccctacgttaccctaaacccgggtagtaaaccggtaccgtaacgttaacccgggaaactaaaccgggtacggtttataaccgttaccgttaaacaaagttaaccgaaacccttaacggtacggggacgaccggaccggtaactaccggtaccggttctttagtaccggngttagggaactacggtaggtcggttacgggttcggggttcccggggttaccggacccttaccggttccggtttggttacccttcgtacgcgtttcggtacgggttcggggtccgttccggtaacccg

SEQ ID NO: 373503 - DNA, 736 bp, Homo sapiens
  misc_feature: GZ8MTXP01DEX5Z.3.52.E08.1.454.CMB.2.raw
  modified_base (301)..(301): a, c, t, g, unknown or other
tcagagacgcactccacgaccggtgctcgattttagtcgagctctctcggcggggggggagaggagcccagcactgggattccgaggtgtttccattcggtgatcagcactgaacacagaggactcaccatggtagttttggctgagtcgttgggtttttccttgttgtcttatttacaaaaggtgtccagtgtgaggtgcgagggtggtggagacgtgggaggaggtcttgactccgaggtccggtgggggtccctgacgtactctcgtgtgcacgtcctcgtggcttcgacgtcagtancagctacatcgctacgtcgggccgcgaggccgtacggagggggaacggggtctagggtaggtcgggtcttataagtttattaactaacttcgtagtaccactataacctacctcccggacccgtagggaaaccgggcctaaacttaaccgcttacccgaccgaaggtaccgtaccgtacgttacccggaaagtaaaccggttaccgggtttataaccttacgttaaaccgaaaagttaccgaaaaccctaacgggtggaaaccggaaccgacccgaaacgtaccgtaccggtttacctttaaatcgtggtacgtacgaaggttaaacgttcgttacggggtacggttccggggttaacccggacccttccgttaccggtttcggtttaacctacgtttcgtacgttcccggttgggtcccgggggccttaaccgg

SEQ ID NO: 373504 - DNA, 656 bp, Homo sapiens
  misc_feature: GZ8MTXP01CCS7O.3.52.E08.1.454.CMB.2.raw
  modified_base (440)..(440): a, c, t, g, unknown or other
tcagagacgcactccacgaccggtgctcgatttagtcgagctctctcggcggggggagaggagcccagcactgggattccgaggtgtttccattcggtgatcagcactgaacacagaggactcaccatggagttttggctgagtcttgggttttccttgttgcttatttcaaaaggtgtccagtgtgaggtgcaggtggtggagacgtggaggaggcttgactccgagccgtgggggtccctgagactctcctgtgcagtcctctggcttcgaccgtcagtagcagctacatcgcacgttcggggcccgaccgaggctaccgaagggggaacgggctagggagtgggtctacgagtttattacaaacttctaggttaccactataaaccttacctcccggaaccccgtgggaaacgggcccgtaaacttaaccattaccnccaagagacgacgttaccgaagaaacgtacggtagttacgtacttacgaaaattcggaaaccaaccgtggaaacggaccgacccgaacgaacctaccgggtacctttttaacgtacgtagtcgacgtagaagtactttcggaagttgggttccgggaacccttccgttacccttcggttctacgtttccgagttccttcgtcgggggcttcccggg

SEQ ID NO: 373505 - DNA, 689 bp, Homo sapiens
  misc_feature: GZ8MTXP01CAAKS.3.52.E08.1.454.CMB.2.raw
  modified_base (302)..(302): a, c, t, g, unknown or other
tcagagacgcactccacgaccggtgctcgatttagtcgagctctctcggcggggggggagaggagcccagcactgggattccgaggtgtttccattcggtgatcagcactgaacacagaggactcaccatggagttttggctgagtcttgggtttttccttgttgcttatttacaaaaggtgtccagtgtgaggtgcgaggtggtggagacgtggaggaggcttgatcgagccggtgggggtccctgacgtactctcctgtcgcacgtcctcgtcggtcttccgaccgtcagtagcagctanatgctacgtcgggtccgaccgaggtcctaccggaagggggacgggtcgtgggaggtcgggtctatacgttactttaactaacgttcgtaggtacccacaactaaacctacccgtccgacccgtagggtacggaccgtacttacactactacagaacgacgtagtaccgaagaaccctaggtctagtactaacgaaatacgaaacccacggggttacgaggtaaccgccggtaaaccgcgtaaccggttaaccttttacgtacgtggacggtacgacgggttaaagtcggttacggttagggttccgggggtttccgaacccgttccgttaccgttcggtttcgtacgttccgttacgtcggttacccgtcgggggttccgttaaccg

SEQ ID NO: 373506 - DNA, 612 bp, Homo sapiens
  misc_feature: GZ8MTXP02F6E8G.3.52.E08.1.454.CMB.2.raw
  modified_base (301)..(301): a, c, t, g, unknown or other
  modified_base (460)..(460): a, c, t, g, unknown or other
tcagagacgcactccacgaccggtgctcgatttagtcgagctctcgttcggcgggggcgaggagtcacgacccagtcaggacacagctatggacatgagggtccccgctcagctcctggggctcctgctgctctggttcccaggttccagattgcgacatccagatgacccagtctccatcctccgtgtctgcatcgtgggtaggggacaggacgtcgcgtatgtacttggtcgggcgtactcggtacggttttaacagtagttggttagtctggtatcagcgaagaaaccgagggaaacnccccgtggtacgttccagactcgtcgtgcgtgcgtactcccgacccgtgaacgtaaaggtcggactccactccgagtattacgacgacgttcgaggtgaacttcgtagggacagtacgttcactctaccaccatcagacacgccagcacgctagaattntttacgactaacttactagtacgtacaaacgtgtacgtcgaacgtcgttcccttaccgtcgttacgttaaccggttcgggacgggtacggtaaccgtaagggttacgaacgtaacgtaacgtaaaacggtaccgttaggtccggcgtaaccg

SEQ ID NO: 373507 - DNA, 551 bp, Homo sapiens
  misc_feature: GZ8MTXP02J17PA.3.52.E08.1.454.CMB.2.raw
  modified_base (272)..(272): a, c, t, g, unknown or other
  modified_base (359)..(359): a, c, t, g, unknown or other
  modified_base (392)..(392): a, c, t, g, unknown or other
  modified_base (440)..(440): a, c, t, g, unknown or other
tcagagacgcactccacgaccggtgctcgatttagtcgagctctctcggcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagactggaggaggcttgatccagccgtggggggtccctgagactctcctgtgcagcctctggcttcaccgtnagtagcagctacatgcacgtgggtccgccaggctccgaggggaaggggctgggagtgggtctcagttattacaattcgtggtaccanatactactccgacccgtgaacgggccataaccntctccagagacgattcgagacacgtgtatcttacaaatgaaactaccngagacgccgacgacaccggtacctttattacgtgtgacgagacgtagtcgaggtcggttacggggacctccgacccgttggtcttactcgacttcgtcgtcggggctccgg

SEQ ID NO: 373508 - DNA, 540 bp, Homo sapiens
  misc_feature: GZ8MTXP02FNJNO.3.52.E08.1.454.CMB.2.raw
  modified_base (340)..(340): a, c, t, g, unknown or other
tcagagacgcactccacgaccggtgctcgatttagtcgagctctctcggcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtgggggtccctgagactctcctgtgcagcctctggcttcaccgtcagtagcagctacatgcactgggtccgccaggctccgagggaaggggctgggagtgggtctcagttattanaattctgtacacatactactccgacccgtgaagggccattaaacatctccagacgacgaattccgaagaacacggtagtatcttacaaatagaaacaacctgagagccgaacgacacggtccgtttaattacgtgtgcgagacgattcggagtggttcgggacctcacccgtggtctacgtcgactcctgtcgggctcgg

SEQ ID NO: 373509 - DNA, 820 bp, Homo sapiens
  misc_feature: GZ8MTXP02I5X8M.3.52.E08.1.454.CMB.2.raw
tcagagacgcactccacgaccggtgctcgatttagtcgagctctctcggcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtccctgagactctcctgtgcagcctctcggcttcaccgtcagtgcagctacatgcacgtcgggtccgccacggcctccggaaggggaacggggcgtgggaggtcggggtctacgtaagtttaatttacgtaaactttccgtacggttaacccaacgtaacttaacccttaacccgtccccggtaacccccggttagggaaaaccgggggtaccccgtaaacgtttaaaaccccgacttcccgttaacccgaacgggtaaacgtaacccgtaaacgttaccccggaaaacgtaaaaccgtacccggggttagttaaacctttaccgttaaccgaaaaacgtttacggaaaacctaaacccgttagggaaacgaaccggacccggaaacgaacccgtaacggggttaccccgtttttaagttaacggtcggttacggaacggaaggttaacgtaaacgtttaccgggaaggggtttcgggggttacccgggggtaaccctttaccccgtaaccccggtttggggtttaaccccttacggtttaccggaacttccggtttcccgggtcgggggttaccccgttaccggggg

SEQ ID NO: 373510 - DNA, 631 bp, Homo sapiens
  misc_feature: GZ8MTXP02JJWFB.3.52.E08.1.454.CMB.2.raw
  modified_base (481)..(481): a, c, t, g, unknown or other
  modified_base (549)..(549): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagactggaggaggcttgatccagccgtggggggtccctgagactctcctgtgcagcctctggcttcaccgtcagtagcagctacatgcacgtgggtccgccaggcctaccgaagggggaaaggggctagggaggtggggtctacgtaagtttaatttaacaaatttcgtaggtaacccaactattaacctacctccccggaaccccgttggaaacggggtccctaaattaaacccattccaccaaaggaagaccgtattcccggaaagaaaccctagggtntaactcttacaaaaattcgaaacaaaccaagagagaccgacgaacgacgtaccgttattactagtagngagagagtagtacggtaggttacgggtaccgtaccgtaacccgtcggttcgtacttacgtactcgtcgtcggggcggtccgg

SEQ ID NO: 373511 - DNA, 618 bp, Homo sapiens
  misc_feature: GZ8MTXP02HLHZG.3.52.E08.1.454.CMB.2.raw
  modified_base (254)..(254): a, c, t, g, unknown or other
  modified_base (262)..(262): a, c, t, g, unknown or other
  modified_base (524)..(524): a, c, t, g, unknown or other
tcagagacgcactccacgaccggtgctcgatttagtcgagctctctcggcggggggagaggagcccagcactgggattccgaggtgtttccattcggtgatcagccactgaacacagaggactcaccatggagttttggctgagctgggttttccttgttgctatttcaaaaggtgtccagtgtgaggtgcaggtggtggagacgtggaggaggcttgatccgaggccgtcgggggtcctgagactctcctgtncagcctgnggcttcaccgtcagtagcagctacatgacacgtcggtccgccgaggcctaccggaggggaagggctgggtacggtgggtctcgtagttattacacttcacgtaccaactactacctactcccgaacccgtaggaaccgggacctaacgtaaccacttccacgaagactaacgacttacgaagtacgtacggtatactacgtaacaagtaactaaaccactggaacgacgtaccgaacgcgtaacgtaccgtttatacgtagngtaacggagtacgtagttcgggaagttccgggggttaacgtacccgtctaccggtattcccgtaagtcgtactccgtcgggacgttaccggccg

SEQ ID NO: 373512 - DNA, 709 bp, Homo sapiens
  misc_feature: GZ8MTXP02JG7YQ.3.52.E08.1.454.CMB.2.raw
  modified_base (250)..(250): a, c, t, g, unknown or other
tcagagacgcactccacgaccggtgctcgatttagtcgagctctctcggcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtggaggaggcttgatccagccgtgggggtcctgagactctcctgtncagcctcgtggcttacaccgtcagtacgcagctacatcgcacgtcggtccgccgaggcctccggaggggacgggcgtagggtaggtcgggtctcgtagttaatttacaacttcgtaggtaccacgtactacctacctcccggacccgtaggaaccggggtacctaacttaaccgtactaccctaccgaaggtaacgaacccgtaacgttacccggaaagtaaaacgtcccggggttaattactaccctttaaagaaaacttacgaaaaccgtaaccgttagaacggaaccgccccggaaaagacccgtacgggttacccttttaataccgttggtaccgacgaacgtaaggttacgtttaccgggagggtttaggggttacccgggtaaccttccgtaacccggtttggttaacccttacgttacggactttccgtcggtaaccgggggtcctaacggg

SEQ ID NO: 373513 - DNA, 627 bp, Homo sapiens
  misc_feature: GZ8MTXP02JVCOP.3.52.E08.1.454.CMB.2.raw
  modified_base (280)..(280): a, c, t, g, unknown or other
  modified_base (449)..(449): a, c, t, g, unknown or other
  modified_base (454)..(454): a, c, t, g, unknown or other
  modified_base (528)..(528): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagctgggttttcctgttgctatttcaaaaggtgtccagtgtgaggtgcaggtggtggagacgtggaggaggcttgatccagccgtgggggtccctgagactctcctgtgcacgcctcgtcggcttcgaccgtcagtanctagctacatgacacgtcgggtccgccgaggctaccggaaggggaacggggcgtagggaggtgggtctacgtaggttacttactaacgttcgtaggtaccatactaccactcccggacccgtaggacgggaccaattacccgatcctacgagacgacgattccggaaanaccgnggttatactcgttaacaaaacgtcgaaaccaacgtggaagaccgtccgaactacgtacgggtactttagtacgngtaggacgtaggtacgtacgtcggtacggtcgggttaccgtaccttccgtaccgttgttaacccgtacgttacgcgttcgtccgggtcgggtcctaacg

SEQ ID NO: 373514 - DNA, 735 bp, Homo sapiens
  misc_feature: GZ8MTXP02HZZHD.3.52.E08.1.454.CMB.2.raw
tcagagacgcactccacgaccggtgctcgatttagtcgagctctctcggcggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatcagcgtgggggtccctgagactctctgtgcagcctctggcttcacgtcagtagcagctacatgccagtcgggtccgccaggctaccgaggggaaggggctagggagtgggtctacgtagttactttacaacttcgtacggtacccaactattacctaaccgtccccgtaacccccggtaggaaaccgggggtcccgtaaaatttaaacccgaactttccctaacccgaaggaacgtaaccggtaacttacccggaaagtaaaaccgtaaccggggttgttaaaacttcccgtttaacaaaaagttacggtaaaaccaaaacccgttggaacggaacgaccccgggttaacgaactaacccggggtacccttttaaagttaaccgtcggttaggaccgtaaaaggaggtaaacgttttcgggaaacggtttcgggggttaccggggaaccctcgtaaacccccgttgggtttaaccctaacgtttcggacttccgttacggtccgggggttaccctcgg

SEQ ID NO: 373515 - DNA, 657 bp, Homo sapiens
  misc_feature: GZ8MTXP02IRV71.3.52.E08.1.454.CMB.2.raw
  modified_base (272)..(272): a, c, t, g, unknown or other
  modified_base (277)..(277): a, c, t, g, unknown or other
  modified_base (285)..(285): a, c, t, g, unknown or other
tcagagacgcactccacgaccggtgctcgatttagtcgagctctctcggcggggggagaggagcccagcactgggattccgaggtgtttccattcggtgatcagcactgaacacagaggactcaccatggagttttggctgagcttgggttttccttgttgctatttacaaaggtgtccagtgtgaggtgcaggtggtggagacgtggaggaggcttgatccagccgtgggggtcctgagactctcctgtgcagcctcgtggcttcaccgtnagtcncagcctanatcgcctacgtcggtcccgacgacggcctaccggaggggacgggcgtgggaggttcggggtctacgtagtttaacttaacgtacgtttccgtacggtaacccactactaccgttacctcccggaccccgtaaggtaaaccggggcctaaacgttaaacccacgttaccacccgaaagaccgtaacgtacgttacccggaaagaacccgtaggttattactacttaaacgaaattaccgaaacacctagacgactccgaacgactacggtacttatagtgtacgagagtacgtacgttaggacgttcggggtaccggtacctcgtacccgttaggtaacttacgtcgtactcgtaccgggtcggccgttacgg

SEQ ID NO: 373516 - DNA, 707 bp, Homo sapiens
  misc_feature: GZ8MTXP02IINJL.3.52.E08.1.454.CMB.2.raw
tcagagacgcactccacgaccggtgctcgatttagtcgagctctctcggcggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtggtggagacgtgggaggaggcttgatccgagccgtgggggtccctgagactctcctgtgcagcctcgtggcttcacgtcagtagcagctacatgcacgtggtccgccaggctaccggaggggaacggggctagggtaggtcgggtctacgtaggtttaactttacgaactttcgtaggtaaccctactacgttaacctaaccgttccccggaaccccggtagggaaaaccgggggtccctaaactttaaacccgattacccgtacccgaaggaaccgtaaccgtaacgttacccggaaaacgtaaaccgtaccggggttattaacgttaccttaaccaaaagttacggaaaaccctaaaccgtgggaaacgacggacccggaaacgacgtaaacccggtacgttttactaacgtggtacgacggaagtagtaacgttcgggaacgttggggtccgggaacctccgtaccgttcggtttaactacgttacgtctcgtccgttcgggggcctcgg

SEQ ID NO: 373517 - DNA, 580 bp, Homo sapiens
  misc_feature: GZ8MTXP02I20MC.3.52.E08.1.454.CMB.2.raw
  modified_base (454)..(454): a, c, t, g, unknown or other
  modified_base (463)..(463): a, c, t, g, unknown or other
  modified_base (509)..(509): a, c, t, g, unknown or other
  modified_base (517)..(517): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagctgggttttccttgtgctatttcaaaggtgtcagtgtgaggtgcaggtggtggagacgtggaggaggcttgatccagccgtgggggtcctgagactctcctgtgcagcctctggcttcacgtcagtagcagctacatgcacgtggtccgcgaggcctccggaggggaagggcgtagggaggtgggtctacgtagtttatttaacaactttcgtaggtaaccagtactacctaccgtcccgaccccgttaggaacgggacctaacttaaaccgcttccaccgagacgaacgtataccgagtaaacacggtntactcttanaaatacgaaacactgagacgcgaacgacaggtccttagtactgtancgagacgngttacgacggtggtacggcctacgtacccgttgtctacgttcgactcgtacgtcgggtcgtcg

SEQ ID NO: 373518 - DNA, 663 bp, Homo sapiens
  misc_feature: GZ8MTXP02HIMW0.3.52.E08.1.454.CMB.2.raw
  modified_base (354)..(354): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggtggtggagacgtggaggaggcttgatccgagccggtgggggtccctgacgactctccgtgtcgacacgtcctcgtggtccttcgaccgtcagtagccagctacatcgcacgtcgggtccgccgaggccgtaccggagggggaacggggtcgtaggggnggtcgggtctacgtaagtttatttaacaacgtttcgtacggtaaccactactacctaccttcccggacccggttagaacggggacctaataacccgattccaccgaagaccgtaacgtacgttacccgaagtaaccgtagggtataacttacttaacgaaattacgaaacctaaccgtggacgaccgaccgaacgacgtaccggtcgtttaaatcgtacgtgacgaagtaagtcgttacggagttccggggtaacggtcctcgtacgttcggtaactacttcggacttcggtcggtcgggtaccgtcgg

SEQ ID NO: 373519 - DNA, 672 bp, Homo sapiens
  misc_feature: GZ8MTXP02HCZTG.3.52.E08.1.454.CMB.2.raw
  modified_base (285)..(285): a, c, t, g, unknown or other
  modified_base (299)..(299): a, c, t, g, unknown or other
tcagagacgcactccacgaccggtgctcgatttagtcgagctctctcggcgggggagtcagacccagtcaggacacagcatggacatgagggtccccgctcagctcctggggctcctgctgctctggttcccaggttccagatgcgacatccagatgacccagtctcatcctccgtgtctgcatctggtagggacagagtcgctatgtacgttggtcgggcgtactcgtacggttttaacaggtattggttagtcgtaggtatcgagcaagaaaccgagggaacncccctgacgttccngatgtctgctgctactcccacctgacgaagtcgacgtccatccagtacttcgaacgtctacgagtacgtacgtcgtagggaactaggtacgttccaccttaccgtaccaaccctagtccgaaacggccaaacgtccccgttacgaccgtaacggttacccgttaaggtaaaacgtttaccgttttaacgaaccctttaaacgtttttaccctaagttttaccgaacgtaaacgtacgggtctaaccgggaacttccggtccccgttacccgtacgttaccgttaacccgggtttcggggaaccgggtaaacggtaaccgtaaggggtacgaacgttaacgaacgtaaacgcgttacgcggactcggactaccg

SEQ ID NO: 373520 - DNA, 610 bp, Homo sapiens
  misc_feature: GZ8MTXP02J36J4.3.52.E08.1.454.CMB.2.raw
  modified_base (259)..(259): a, c, t, g, unknown or other
  modified_base (418)..(418): a, c, t, g, unknown or other
  modified_base (513)..(513): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggtgtggagactggaggaggcttgatccagccgtgggggtccctgagactctcctgtgcagccttcnggcttcaccgcagtagcagctacatgcacgtcgggtccgccaggcgtaccgaggggaaaggggctgggagttggggtctacgagtttatttacaacttctaggtcccacataacctactccgaaccccgtcgaacggggccgaattaccactactccanagacgacgtaccgtacgaacgaaaccggtgtactacttactaaactaactaaacgaaaccagtacgacgacgaccgacgacgtacgttctacttntagcgagtagagttagtacgtagggttcgggtaccggtaccgtccctacgttaaccgttcgttaaccttctctccgtttcgggtacgggttcccggg

SEQ ID NO: 373521 - DNA, 675 bp, Homo sapiens
  misc_feature: GZ8MTXP02H0DX2.3.52.E08.1.454.CMB.2.raw
  modified_base (607)..(607): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggtagttttggctgagtcgttgggttttccttgttgcttatttacaaaggtgtccagtgtgaggtgcgaggtggtggagacgtgggaggaggcttgatccgagccggtcgggggtccctggacgtactctccgtgtgcacgtcctcgtcggtccttccgaccgtcgaagtacgacacgactacagtcgaccgtacggtcgggtcccgaccgacggcccgtaccggaagggggacggggtcggtagggtaggttcggtactacgttaaagtttactttacacgtttcgtacgtaccacgtacttaccgtacccgtcccggtacccgtaggaaccggtacctaaactaccattaccacgagaccgtacgtacgtaccgaagtaacgtcggtatactagttaaacaaatacgaaacctacgagaacgacgaccgaaccgacgtaccgttactttagactggagacgaatggttagtacggnggttacgggtcccgtactccgtaccgttgttaacccgtgtacgtcgttccgtcggtcgggtccccgtg

SEQ ID NO: 373522 - DNA, 757 bp, Homo sapiens
  misc_feature: GZ8MTXP02HADOW.3.52.E08.1.454.CMB.2.raw
tcagagacgcactccacgaccggtgctcgatttagtcgagctctctcggcgggggggagaggagcccagcactgggattccgaggtgtttccattcggtgatcagcactgaacacagaggactcaccatggtagttttggctgagcttgggttttccttgttgctatttacaaaaggtgtccagtgtgaggtgcgaggtggtggagacgtggaggaggtcttgatccgagccggtgggggtccctgagactctcctgtgcagcctctggcttcgaccgtcagtcgcagctacagtcgccacggtcgggtccgccgaggccgtccggaagggggaacggggtcgtagggtaggtcgggtacttacgtaaggtttatttaactacgtttccgtacggttacccaacgtacttacccgttaaccgtccccggtaaccccgttagggaaaccggggtaccctaacgttaaacccacttcccgtaacccgaagggaacccgtaaacgtacgttaaccccgggaaagtaaacccgtacggggttacttaaacgttaccttaaaacgaaaactaaccggtaaaaccttaaaccgaggtaacgaaccggacccgtaacgaaccgtaccgggttacctttaggttaaccgtggtacgacggtaaaggacgttagttaccggggaggtttccggggtaccggggtacctaccgtaccggtttggtaaccttacgttacgtcgtccgtacgggtcgggggtcctacgg

SEQ ID NO: 373523 - DNA, 717 bp, Homo sapiens
  misc_feature: GZ8MTXP02JQYJB.3.52.E08.1.454.CMB.2.raw
  modified_base (569)..(569): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggtagttttggctgagtcttgggttttccttgttgcttatttacaaaaggtgtccagtgtgaggtgcgagggtggtggagacgtggaggagcttgactccgaggccggtgggggtccctggacgtacctcgtccgtgtcgcacgtcctcgtggtccttaccgaccgtcagtacgccagtcctacagtcgacctacggtcgggtcccgaccgtaggcctaccgggaaggggaacggggtccgtgggtacggttcgggtctacgttaagtttactttaacgtaactttcgtacgtaacctactactaccgtacccgtacccggtaaccccggttaggaaccggtaacctaacgttaaacctcgttacccaacgagtaaaccgtaccgtagttacccgaaagtaaccgtcggtatacttactaaacaaatacgaaacctacgngacgacgaccacgtactcggttactttaatcgtgagtacgaagtacgtacggttgaaacggggttcggtccgggtaaacctcccggtttaccgtacggtttcctaaacgttaccgttcgtccgttccgggggtacgggtccgtcccgg

SEQ ID NO: 373524 - DNA, 683 bp, Homo sapiens
  misc_feature: GZ8MTXP02FM03K.3.52.E08.1.454.CMB.2.raw
  modified_base (173)..(173): a, c, t, g, unknown or other
  modified_base (255)..(255): a, c, t, g, unknown or other
  modified_base (293)..(293): a, c, t, g, unknown or other
  modified_base (469)..(469): a, c, t, g, unknown or other
tcagagacgcactccacgaccggtgctcgatttagtcgagctctctcgtggggctgggagaggagcccagcactgggattccgaggtgtttccattcggtgatcagcactgaacacagaggactcaccatggagttttggctgagcgtggtttctgtagctattacaaaggtntcagtgtgaggtgcaggtggtggagacgtggaggaggcttgactccgagtccgtgggggtccctgagtctcgtcctgtcgcngcctcgtgccttcgaccgtgacgtagccagctacagtncgacgtcgggcccgcaacggcctaccgggaggggtaacggggtccgtaggggtaggttccggggtacgtaccgttaaggttttaactttaaacgtacgttcgtacgtaaccctaattactaccgtccttaccccggaccggttaacgacgggtacctacttaaaccacgtcaacgngaagtacgtaactaccggagtaacgtacggttatactacttaaccgaaataacggaacccaagtcgaaacgaccgacccgaaacgtcgtaccggttaccgttatttaccggtgtacgacggatacggttacgtacggttacgggttaccgggtaccggacccttaccggtaaccgtttcgtttacgtaccgttcgtacgttccggtcggtacgg

SEQ ID NO: 373525 - DNA, 738 bp, Homo sapiens
  misc_feature: GZ8MTXP02F3UEM.3.52.E08.1.454.CMB.2.raw
  modified_base (259)..(259): a, c, t, g, unknown or other
  modified_base (306)..(306): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagctgggttttccttgttgctatttacaaaggtgtccagtgtgaggtgcaggtggtggagactggaggaggcttgatccagccgtgggggtccctgagactctcctgtcgcagtccnctggcttcaccgtcagtacgcagctacatcgacacgtgggtaccccnccaggcctccggaggggaacggggtctagggacgtcggggtctacgtagtttaactttacaaaccgtttcgtaggtaacccactaaacttacccgaccttccccggaacccccggtaggaaacgggggaccctaacttaaccgactccgtacccaagacggaacgtacttacccggaaagtaacccgacggttacgtaacttctttaaaccgaaaattacggaaaaccctaaacgtacgaaacggaccgtaacccgggaaccgtaacccgtaacggggtaacctttttacgttaaccgtggtacgtaccgggaatacggtacgtttcggtaaacggggtccgggtttaacccggggacccttacggtaacccccgtttggttaaccttacccgttacggacttaccgtccggggtccggggtacgttcccgg

SEQ ID NO: 373526 - DNA, 656 bp, Homo sapiens
  misc_feature: GZ8MTXP02GF1EY.3.52.E08.1.454.CMB.2.raw
  modified_base (287)..(287): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggtggtggagacgtgggaggaggcttgatccgaggtccggtggggggtccctggacgtactctccgtgtgcacgcctctcggtcttacaccgtnacgtagcagcacatcgcacgtcgggtccgcgaggcctaccggaggggaacgggcgtagggaggtgggtctacgtagttattacaacttcgacgtaaccactactacctaccgtcccgtacccggtaggaacgggtcctaactaaccgactcctaccgaagtacgacgtacgtaccgaagaaaccgtcggttattactaccttaacaaagtcgaaactaccgtaggaaccacggacccggaaagtaaaccggttcctttaaagtccgtagacgagaagtatacgttacggaggttccggggtaaccggccttacgaccgtggtttacctaacgtacgctttcggtccggtcggggtcccgtcggtacccg

SEQ ID NO: 373527 - DNA, 790 bp, Homo sapiens
  misc_feature: GZ8MTXP02FYGWO.3.52.E08.1.454.CMB.2.raw
  modified_base (251)..(251): a, c, t, g, unknown or other
  modified_base (277)..(277): a, c, t, g, unknown or other
  modified_base (301)..(301): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggtggtggagactggaggaggcttgatccaggccgtgggggtccctgagactctcctgtncacgcctctggcttcaccgtcagtancagctacatcgcacgtcgggtccncgaggctccggaaggggaacggggtctaggggagtcggggtactacgtaagtttacgtttaactaacgtttccgtacggtaaccctacgaacttacccgttaccgtccccggaacccccggttaggaaaccggggtcccgtaaactttaaaccgcttacccgtaccgaaggtaaacgtaccgtaacgttacccggaaagtaaaccggtaccggttaagttaaacttcttaaacctaaaagttaaccggaaaaaccgtaacccgttagggaaacgaccggaaccccgggtaaacgtaaccccgtaaccgggggtttaccttttaaacgtttaaacgggtccggttaggaccgtaaaggtacggttaccgttaggggtaaacggtttcgggggttacccgggggtaccttacccggtacccggttttacgggttaacccttaaccgtttacgggtacttcccggttcgggtaccggggtcccgtaccgggg

SEQ ID NO: 373528 - DNA, 889 bp, Homo sapiens
  misc_feature: GZ8MTXP02IZNKP.3.52.E08.1.454.CMB.2.raw
tcagagacgcactccacgaccggtgctcgatttagtcgagctctctcggcgggggggagaggagcccagcactgggattccgaggtgtttccattcggtgatcagcactgaacacagaggactcaccatggagttttggctgagctgggttttccttgttgcttatttcaaaaggtgtccagtgtgaggtgcaggtggtggagacgtggaggaggcttgatccaggccgtgggggtccctgagactctcctgtgcagcctctggccttcgaccgtcagtcgcagctacatgacacgtcgggtccgccgacggccgtacccggaagggggaaggggccgttaggggtacggtcggggttcccttaccgttaaggttttaaacgtttaactaacgtttccgtacggggttaacccacgttaacttaacccgttacccgttcccccggtaacccccggttagggaaaaccgggggtccccgttaaacgtttaaacccccatttaccccgtaacccgaaaggaacccggtaacgggttaactttaccccggaaaaggtaaaacccggtaccggggtttaagttaaactttacccgttaaaaccaaaaagtttaccgggaaaaaccccttaaacccggttaagggtaaaccgggtaaccggacccccgggtaaaaccgaacccggttaacccggggtttaacccggtttttaacgtttaaacccgtgggttaacgaacccggggttaaaggtaaacgggttacgttttacccggggaagggtttaaccgggggtttcccgggggtaaccccttacccgttaaaccccgggtttggttaacccgttaacgttccgtaccgttcgttcccgggttcgggggtacccgtttcccggg

SEQ ID NO: 373529 - DNA, 603 bp, Homo sapiens
  misc_feature: GZ8MTXP02F3MRH.3.52.E08.1.454.CMB.2.raw
  modified_base (255)..(255): a, c, t, g, unknown or other
  modified_base (258)..(258): a, c, t, g, unknown or other
  modified_base (276)..(276): a, c, t, g, unknown or other
  modified_base (471)..(471): a, c, t, g, unknown or other
  modified_base (485)..(485): a, c, t, g, unknown or other
tcagagacgcactccacgaccggtgctcgatttagtcgagctctctcggcgggggggagaggagcccagcactgggattccgaggtgtttccattcggtgatcagcactgaacacagaggactcaccatggtagttttggctgagcttgggttttccttgttgctattacaaaaggtgtccagtgtgaggtgcagggtggtggagacgtgggaggaggcttgatccaggccggtgggggtcctgagactctctgngcngcctcgtgtctcaccgtnagtacgcagctacatcgctacgtcgggtccaccgtaggcctaccggaagggggaggggtcctagggtaggtcgggtctacgtagtttacgtactacgtcgtacgacactagtacctcgcccggtaccgtagaacgggtcctaactactactctaccagacgacgactacgaacgtaacgacggttatactctaanaatacgaactacgngagacgcgaacgacgacgtacttactactcgtagcgtagtgtaaaagtcggtacggtcgggttacggacctaccgtacgttacgtcgttacgtacgtacgtcgtcggtcggcgtccgg

SEQ ID NO: 373530 - DNA, 548 bp, Homo sapiens
  misc_feature: GZ8MTXP01EO3TW.22.82.H05.1.454.CMB.2.raw
  modified_base (297)..(297): a, c, t, g, unknown or other
  modified_base (386)..(386): a, c, t, g, unknown or other
  modified_base (405)..(405): a, c, t, g, unknown or other
  modified_base (416)..(416): a, c, t, g, unknown or other
  modified_base (425)..(425): a, c, t, g, unknown or other
  modified_base (432)..(432): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggcgttttctagtggctattttaaaacgtgtccagtgtgaggtgcagctggcggagtctgggggagcctggtacagccggggggtcctgagactctcctgtgtagcctccggattcacctttagcagacatggcatgagctgggtccnccaggctccagggaaggggccgagtgggtgtcaggtcattagagtagtggtgatagaatttacacaacagaactccgtgaaaggggccncttcaccatctctaggaanacaactccaanaacacactntatctanacaagtagagtagacgagagacgacgacgacgacgactacttattaactcgcgacgaaggagtaagttacggttcgacgaacggtacggtcgtacgtacgttacgtaacgttgtcg

SEQ ID NO: 373531 - DNA, 629 bp, Homo sapiens
  misc_feature: GZ8MTXP01BHL8M.22.82.H05.1.454.CMB.2.raw
  modified_base (175)..(175): a, c, t, g, unknown or other
  modified_base (273)..(273): a, c, t, g, unknown or other
  modified_base (275)..(275): a, c, t, g, unknown or other
  modified_base (277)..(277): a, c, t, g, unknown or other
  modified_base (279)..(281): a, c, t, g, unknown or other
  modified_base (283)..(283): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctatttaaacgngtccagtgtgaggtgcagctggcggagtgtggggaggcctggtacgagccgggggtcccgtgagctctcctgtgtgcctccggattcacctttagcananangnnngngcgtcggtccgcgcgcgcgagggacggggcggaggtggtgtcgagtgtagttagtagtaggtggtagtagtagtaacttacacaacacgtcgtacgtacggacgggccgtccgtactactactactacgtacgacgaactaactacccgaacgaacaacctactacgtactactacgtactaagtacgtacgtacggtacgtagacgacggaccgaccgaaccgtaccgtaccgttaactttacttaacgtcgacggacggaaggtaagtaacggttaacgggttaccgggttaacggtaacgggtacggtaaccgttacgttacgttacgttaacgttaacgtcg

SEQ ID NO: 373532 - DNA, 562 bp, Homo sapiens
  misc_feature: GZ8MTXP01BW8WC.22.82.H05.1.454.CMB.2.raw
  modified_base (370)..(370): a, c, t, g, unknown or other
  modified_base (410)..(410): a, c, t, g, unknown or other
  modified_base (421)..(421): a, c, t, g, unknown or other
  modified_base (436)..(436): a, c, t, g, unknown or other
  modified_base (438)..(438): a, c, t, g, unknown or other
  modified_base (443)..(443): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctattttaaacgtgtcagtgtgaggtgcagctggcggagtctggggggagcctggtacaggccgggggggtccctgagactctcctgtgtagcctccggattcacctttagcagacatggcatgagctgggtccgccaggctccgagggggaaggggccggagtgggtgtcaggtcattagtagtagtggtgatagaattaccanaacagaacctcgaggaacgggcctctacacatctacaganacacttccaanacacagtatactcananagtanagtagacgagagacgacgacgacgacgtactacttataacgtcgacgacgagtaacgtacggttacgggttacggacggtaacggtacggtaacgtacgtcgttacgtaacgttcgtcg

SEQ ID NO: 373533 - DNA, 516 bp, Homo sapiens
  misc_feature: GZ8MTXP01D97GK.22.82.H05.1.454.CMB.2.raw
  modified_base (442)..(442): a, c, t, g, unknown or other
  modified_base (513)..(513): a, c, t, g, unknown or other
tcagacatacgcgtcacgaccggtgctcgatttagtcgagctctctcgcggggtctgagagaggagcccagccctgggattttcaggtgtttcatttggtgatcaggactgaacagagagaactcaccatggagtttgggctgagctgacttttcttgtggctatttaaaacgtgtccagtgtgaggtgcagctggcggagtctgggggagcctggtacagccggggggtccctgagactctcctgtgtagcctccggattcacctttagcagacatggcatgagctgggtccgccaggctccagggaaggggccggagtgggtgtcagtcattagtagtagtggtgatagaatttaccacaacagctccgtgaagggccgcttcaccatctctagagacaattcccagaacacactgtatctgcaaatgactaggctgagngccgacgacacggccatttataactgcgcgaaggatattcgggttcacgaacggtgctacgcgttctaagntcg

SEQ ID NO: 373534 - DNA, 588 bp, Homo sapiens
  misc_feature: GZ8MTXP01E5CHM.22.82.H05.1.454.CMB.2.raw
  modified_base (150)..(150): a, c, t, g, unknown or other
  modified_base (174)..(174): a, c, t, g, unknown or other
  modified_base (260)..(260): a, c, t, g, unknown or other
  modified_base (269)..(269): a, c, t, g, unknown or other
  modified_base (271)..(271): a, c, t, g, unknown or other
  modified_base (273)..(273): a, c, t, g, unknown or other
  modified_base (275)..(275): a, c, t, g, unknown or other
  modified_base (277)..(277): a, c, t, g, unknown or other
  modified_base (279)..(279): a, c, t, g, unknown or other
  modified_base (289)..(289): a, c, t, g, unknown or other
tcagacatacgcgtcacgaccggtgctcgatttagtcgagctctctcgcggggtctgagagaggagcccagccctgggattttcaggtgtttcatttggtgatcaggactgaacagagagaactcaccatggagtttgggctgagcgtgngtttctagtggctatttaaaacgngtccagtgtgaggtgcagctggcggagtctggggagggcctgatacagcggggggtcccgtgagactctcctgtgtagctccgatnccttagcananangnangngcgtggcgcngcgcgagggagggcggaggtggtgtcagtctagttagtagtagtggtagatagtaattaaccaaacaacaacgacgtccgtacggacgggccgctacacctactctactagagaactaacttaccaacgaacaacactagtatactagacgaaatagtacgtacggacgtaggaggacgaccgaccgaaccgaaccggacctaactttaacttaacgttacgacggacggaaacggtaagttacggttacgggttacggaacgacggtaacggtcgtacgttacgtttcgttaagtaag

SEQ ID NO: 373535 - DNA, 550 bp, Homo sapiens
  misc_feature: GZ8MTXP01DRW8X.22.82.H05.1.454.CMB.2.raw
  modified_base (307)..(307): a, c, t, g, unknown or other
  modified_base (344)..(344): a, c, t, g, unknown or other
  modified_base (411)..(411): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctaatttaaacgtgtcagtgtgaggtgcagctggcggagtcgtgggggagcctggtacaggccggggggtccctgagactctcctgtgtagcctccggattcacctttagcagacatggcatgagcgtggtccgccgaggcncccgaggggaagggggaccggaggtgggtgtcgagtntattagtagtagtggtgatagtaattacacaacagctccgtagaagggcgctcacactctctagaanacactaccacaacacactatatactaacaatagactagacgagagacgacgacgacgacgtactacttactctcgcgagaagagtacgtacggttacgacgacggtcgtcgtaacgtcgttacgttacgtcgttcgtcg

SEQ ID NO: 373536 - DNA, 611 bp, Homo sapiens
  misc_feature: GZ8MTXP01C8PY1.22.82.H05.1.454.CMB.2.raw
  modified_base (334)..(334): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgcgtttctaggtggctatttaaaacgtgtccagtgtgaggtgcagctggcggagtctgggggagcctggtacagccgggggggtccctgagactctcctgtgtagcctccggattcacctttagcagacatggcatgagctggtcgccaggcgtccagggaaggggccggagtgggtgtcgagtnattagtagtagtggtggatagaattacacaacagaactccgtgaaagggcgcttcacactctctagaagactactaccacaacacactatatactacgacaaagtacgtaacgtacgtacgtacgacgacgaccgaccgaccgtaccgtaccgtaactttaacttaacgtacgttacggtaacggaaacggtaaacgtaacggttaaccgggttaccggttaacggtaacgggtacggtaaccggttacggttacgtttacgttaacgttaacgtcg

SEQ ID NO: 373537 - DNA, 546 bp, Homo sapiens
  misc_feature: GZ8MTXP01ATQ5E.22.82.H05.1.454.CMB.2.raw
  modified_base (295)..(295): a, c, t, g, unknown or other
  modified_base (384)..(384): a, c, t, g, unknown or other
  modified_base (398)..(398): a, c, t, g, unknown or other
  modified_base (402)..(402): a, c, t, g, unknown or other
  modified_base (414)..(414): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctagtggctatttaaacgtgtcagtgtgaggtgcagctggcggagtctgggggagcctggtacaggccggggggtcctgagactctcctgtgtagcctccggattcacctttagcagacatggcatgagctgggtccncaggctccgaggggaggggccgagtgggtgtcagtcattagtagtagtggtgatagaatttaccacaacagaactccgtgaacgggccncttcaccatcctanaganactaactccaanaacactactagtatctagacaacgtacgtacgtacgacgtagagacgacgacgacgacgactacttataactcgcgacgagagtagttacggttcgacgaacggtcggtcgtcgtcgttacgtaacgttgtg

SEQ ID NO: 373538 - DNA, 554 bp, Homo sapiens
  misc_feature: GZ8MTXP01DV81G.22.82.H05.1.454.CMB.2.raw
  modified_base (401)..(401): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctaggtggctatttaaacgtgtcagtgtgaggtgcagctggcggagtcgtgggggagcctggtacaggccggggggtcctgagactctcctgtgtagcctccggattcacctttagcagacatggcatgagctggccgccgaggcgccaggggaagggggccggaggtgggtgtcgagtgattagtagtagtggtgatagaattacacaacagctccgtgaacggcggcttcacatctctagaanacactacaacaacacactatatactacgacaagtagtacgtacgacgagacgacgacgacgacgtacgtactacttataactgacgacgaagtaagtacgttacggttacgacgtaacggtacggtaacgtacgtcgttacgtaagttcgtcg

SEQ ID NO: 373539 - DNA, 582 bp, Homo sapiens
  misc_feature: GZ8MTXP01DZKM4.22.82.H05.1.454.CMB.2.raw
  modified_base (299)..(299): a, c, t, g, unknown or other
  modified_base (460)..(460): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctaattttaaaacgtgtccagtgtgaggtgcagctggcggagtcgtgggggagcctggtacaggccggggggtcctgagactctcctgtgtagcctcggattcaccttagcagacatggcatgagctgggtccnccgaggcctccgagggggaacgggggccggagtggggtgtcaggtctattagtagtagtggtagatagaatttaccacaacagtcgtccgtaggaacgggccctcttcaactatcttacaagacactaaacttccccaagaaccacacgtataactctaanacaagtagacgtacgacgacgagacgaccgacgaccgtacgtactacttattaactgacgacgagtagtagttacggttacggacgaacggtacggtcgtacgtcgttacgtaacgttgtcg

SEQ ID NO: 373540 - DNA, 596 bp, Homo sapiens
  misc_feature: GZ8MTXP01C8IS4.22.82.H05.1.454.CMB.2.raw
  modified_base (285)..(285): a, c, t, g, unknown or other
  modified_base (287)..(287): a, c, t, g, unknown or other
  modified_base (289)..(289): a, c, t, g, unknown or other
  modified_base (291)..(291): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttctagtggctattttaaaacgtgtccagtgtgaggtgcagctggcggagtcgtggggaggccgtggtacgaggccgggggtcccgtgagactctcctgtgtagcctcggattcacctttagcagacagngnangngcgcggcgcgcgcgcggagggacgggcggaggtggtgtcgagtagtagttagtagtagtaggtagtagtaagtaacttaacaacaaacacgtaacgtaccgtacggacgggaccgtacctacctactactactactaagaacgaactaactaaccaacgaacaactactacgtactactacgaacaagtagtacgtacgacgagagacgacgacgacgtacgtactacttatcgtcgacgacgagtagtaacgttacggttacgacgtaacggtacgtcgtacgtacgttacgtaacgttcgtcg

SEQ ID NO: 373541 - DNA, 580 bp, Homo sapiens
  misc_feature: GZ8MTXP01CRIYN.22.82.H05.1.454.CMB.2.raw
  modified_base (341)..(341): a, c, t, g, unknown or other
  modified_base (379)..(379): a, c, t, g, unknown or other
  modified_base (405)..(405): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctaattttaaaacgtgtcagtgtgaggtgcagctggcggagtcgtgggggagcctggtacgaggccggggggtcctgagactctcctgtgtagcctccggattcacctttagcagacatggcatgagctgggtccgccaggctccgagggggaacgggggtccggaggtggggtntcaggtcattagtagtagtggtgatagatttacccaanaacagcgtcgaggacggcctctcacntctacagacactaactaccaacaacactactatactactatacaagtacgtacgtacgacgtagagacgacgacgacgtacgtactacttacttaacgtcgacgacgaaggtaacgtacgttacgggttacggacgtaacggtacggtcgtacgtacgttacgtaacgttcgtcg

SEQ ID NO: 373542 - DNA, 607 bp, Homo sapiens
  misc_feature: GZ8MTXP01EJBBG.22.82.H05.1.454.CMB.2.raw
  modified_base (288)..(288): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctaggtggctaatttaaacgtgtccagtgtgaggtgcagctggcggagtcgtgggggagcctggtacaggccggggggtcctgagactctcctgtgtagcctccggattcacctttagcagacatggcatgngcgtcggtccgcgcgcgcgacgggacgggcggaggtggtgtcgagtgtagttagtagtagtggtgtagtagtaattactacaacacgcgtacgtacgacggccgtctacactactactactagagactaactaccaacgaacaactactacgtactactacgtactaaacgtagtaacgtacgtacgtagacgacgaccgaaccgaaccgtaccgaccgtacttaacttaacgtacgacggacgaaacggtaagtaacgttacgggttacggaacgtaacggtacggtaacgtacgtacgttacgtaacgttaacgtcg

SEQ ID NO: 373543 - DNA, 540 bp, Homo sapiens
  misc_feature: GZ8MTXP01DS4KR.22.82.H05.1.454.CMB.2.raw
  modified_base (299)..(299): a, c, t, g, unknown or other
  modified_base (366)..(366): a, c, t, g, unknown or other
  modified_base (386)..(386): a, c, t, g, unknown or other
  modified_base (402)..(402): a, c, t, g, unknown or other
  modified_base (477)..(477): a, c, t, g, unknown or other
  modified_base (536)..(536): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccggggggtcctgagactctcctgtgtagcctccggattcacctttagcagacatggcatgagctgggtccncaggctccgaggggaggggccggagtgggtgtcaggtcattagtagtagtggtgatagaattaccanaacagctcgtgaacgggccncttcacatctctaganacaattcccaagaacacactgtatctgacaaaagttgaacttagggctgagagccgaacgacacggctaattttnaactgcgagaaggaatgttaacgggttgaacgtaacgggtgcgtacgcgttttacaagngtcg

SEQ ID NO: 373544 - DNA, 568 bp, Homo sapiens
  misc_feature: GZ8MTXP01B3UDU.22.82.H05.1.454.CMB.2.raw
  modified_base (304)..(304): a, c, t, g, unknown or other
  modified_base (401)..(401): a, c, t, g, unknown or other
  modified_base (431)..(431): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggcgttttctaggtggctattttaaaacgtgtccagtgtgaggtgcagctggcggagtcgtgggggaggcctggtacaggccgggggggtccctgagactctcctgtgtagcctccggattcacctttagcagacatggcatgagctggggtccnccgaggctccgagggggaaggggccggagtggggtgtcaggtcattagtagtagtggtgatagaatttaccacaacagaactccgtagaacgggccncttcaccatctctagagacaattcccaaanaacactactagtactctagacaagtacgtacgtacgacgtagagacgacgacgacgtacgactacttataacgtcgcgacgagagtacgttacggttcgacgtaacggtcgtcgtcgtcgttacgtaacgttcgtcg

SEQ ID NO: 373545 - DNA, 543 bp, Homo sapiens
  misc_feature: GZ8MTXP01BQ6OY.22.82.H05.1.454.CMB.2.raw
  modified_base (335)..(335): a, c, t, g, unknown or other
  modified_base (368)..(368): a, c, t, g, unknown or other
  modified_base (404)..(404): a, c, t, g, unknown or other
  modified_base (432)..(432): a, c, t, g, unknown or other
  modified_base (434)..(434): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgcgttttctagtggctatttaaacgtgtcagtgtgaggtgcagctggcggagtctgggggaggcctggtacagccggggggggtccctgagactctcctgtgtagctccggattcacctttagcagacatggcatgagctggtcgccaggcgccgagggaggggccgggaggtgggtggtcgagtnattagtagtagtggtgatagattactacaacanaactcgtcgaagggcggcttcacactctctagaganaacttaccacaacacactatattactananaagtagtacgtagagagagacgacgacgacgacgactacttattaactcgcgacgagagtagttacggttcggacgaacggtacggtcgtcgtcgttcgtaacgttgtg

SEQ ID NO: 373546 - DNA, 588 bp, Homo sapiens
  misc_feature: GZ8MTXP01CA0BE.22.82.H05.1.454.CMB.2.raw
  modified_base (275)..(275): a, c, t, g, unknown or other
  modified_base (277)..(277): a, c, t, g, unknown or other
  modified_base (279)..(279): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctatttaaagtgtcagtgtgaggtgcagctggcggagtctgggggagcctggtacaggccggggggtcctgagctctcctgtgtagcctccggattcacctttagcagacangnangagcgtcggtccgcgacgcgcggaggggacggggacggaggtgggtgtcgtagtagtagttagtagtaggtggtagtatagtaacttaacctaacaaacacgtaacgtaccgtacggacgggaccgtcctacctactactactactagacgaactaactaccaacaacactactagtactactacgtactaaacgtacgtacgtacgtacgtagacgacgaccgacgacgtacgactacttataactcgcgacgagtagtagttacggttcgacgaacggtacgtcgtcgtcgttacgtaacgttgtcg

SEQ ID NO: 373547 - DNA, 553 bp, Homo sapiens
  misc_feature: GZ8MTXP01CB35S.22.82.H05.1.454.CMB.2.raw
  modified_base (372)..(372): a, c, t, g, unknown or other
  modified_base (425)..(425): a, c, t, g, unknown or other
  modified_base (432)..(432): a, c, t, g, unknown or other
  modified_base (434)..(434): a, c, t, g, unknown or other
  modified_base (451)..(451): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctattttaaaacgtgtccagtgtgaggtgcagctggcggagtctgggggagcctggtacaggccgggggggtccctgagactctcctgtgtagcctccggattcacctttagcagacatggcatgagctggtccgccaggcgtccgagggaagggggccgggaggtgggtgtcgagtcatagtagtagtggtgatagattacacaacanctcgtgagggcggcttcacactctctagagacaacttaccaacgaacacactntatctananaagtagtacgtagacgngagacgaccgacgacgacgactacttattaactcgcgacgaagtagtacgttacgggttacgacggaacggtacggtcgtacgtcgttacgtaacgttgtcg

SEQ ID NO: 373548 - DNA, 540 bp, Homo sapiens
  misc_feature: GZ8MTXP01AX4K2.22.82.H05.1.454.CMB.2.raw
  modified_base (435)..(435): a, c, t, g, unknown or other
  modified_base (489)..(489): a, c, t, g, unknown or other
  modified_base (533)..(533): a, c, t, g, unknown or other
  modified_base (538)..(538): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctagtggctattttaaaacgtgtccagtgtgaggtgcagctggcggagtctgggggaggcctggtacaggccgggggggtccctgagactctcctgtgtagcctccggattcacctttagcagacatggcatgagctgggtccgccaggctccgaggggaaggggccggaggtgggtgtcagtcattagtagtagtggtgatagaatttaccacaacagctccgtgaagggcccgcttcaccatctactagacgacaattccccaagaacacacctntactctgcaaatgactaggctagagagccgacgacacggcctatttataactgnggcgaaggatagacggttcgacgaagggtgcgtacgccggtttntaagntg

SEQ ID NO: 373549 - DNA, 553 bp, Homo sapiens
  misc_feature: GZ8MTXP01DW185.22.82.H05.1.454.CMB.2.raw
  modified_base (299)..(299): a, c, t, g, unknown or other
  modified_base (549)..(549): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttcttgtggctattttaaacgtgtccagtgtgaggtgcagctggcggagtcgtgggggaggcctggtacaggccgggggggtccctgagactctcctgtgtagcctccggattcacctttagcagacatggcatgagctgggtccncaggctccgagggggaaggggccggagtgggtgtcagtcattagtagtagtggtgatagaatttaccacaacagctccgtagaacgggccgcttcacctatcctctagagacaattccccaagaacacactgtaatctagacaaatcgactaggctagagagcccgaagaccacggacctaattttataactgcgacgaaaggtatagttacggggttcacgaacgggtgccttacgccgttttataagngtcg

SEQ ID NO: 373550 - DNA, 540 bp, Homo sapiens
  misc_feature: GZ8MTXP01A2F9Z.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttatttaaaacgtgtccagtgtgaggtgcagctggcggagtcgtgggggaggcctggtacaggccggggggtcctgagactctcctgtgtagcctcggattcacctttagcagacatggcatgagctgggtccgccaggctccgaggggaaggggccggagtggggtgtcagtcattagtagtagtggtgatagaatttaccacaacagctccgtgaagggccgcttcacatctctagagacaattcccaagaacacactgtatctagacaaatgactaggctagagagccgacgacacggccatttataactgcgacgaaggatagttacgggttcgacgaaacggtggctacggcgtttacgtaagttaatcg

SEQ ID NO: 373551 - DNA, 563 bp, Homo sapiens
  misc_feature: GZ8MTXP01AFD0N.22.82.H05.1.454.CMB.2.raw
  modified_base (389)..(389): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccggggggtcctgagactctcctgtgtagcctccggattcacctttagcagacatggcatgagctgggtccgcaggctccgaggggaagggggccggagtgggtgtcagtcagttagtagtagtggtgatagaatttaccacaacagctcgtagaagggccncttcacatctactagagactaacttcccaagaacacacctgtactctagacaaagtcgacgtaggcgtagaacgacgaccgaacgaccgaccggtacctatttataactgcggacgaaggataacggttacgggttacgacgaacgggtggctacggtcgtttcgtaagcgtcg

SEQ ID NO: 373552 - DNA, 608 bp, Homo sapiens
  misc_feature: GZ8MTXP01AME5D.22.82.H05.1.454.CMB.2.raw
  modified_base (176)..(176): a, c, t, g, unknown or other
  modified_base (331)..(331): a, c, t, g, unknown or other
  modified_base (392)..(392): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgcgttttctagtggctatttaaaacgngtccagtgtgaggtgcagctggcggagtcgtgggggagcctggtacaggccggggggtccctgagactctcctgtgtagcctccggattcacctttagcagacatggcatgagctgggtccgcaggctccgaggggaaggggccggagtggggtntcaggtcagttagtagtagtggtgatagaactttacacaacagaacgtccgtgaagggccncttcacctatctctagacgactaacttacccaaagaaccactactacgtactcagtaacaacgtacgtaacgtacgtacgtacgacggacgaccgaccgaaccgtaccgtacctacttacgttaacgtacgacggtacgaacggtaacgtaacggttacgggttacggttaccggtaacggtacggtaacgtacgtacgttacgtaacgttcgtcg

SEQ ID NO: 373553 - DNA, 551 bp, Homo sapiens
  misc_feature: GZ8MTXP01D0CKF.22.82.H05.1.454.CMB.2.raw
  modified_base (366)..(366): a, c, t, g, unknown or other
  modified_base (390)..(390): a, c, t, g, unknown or other
  modified_base (422)..(422): a, c, t, g, unknown or other
  modified_base (431)..(431): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttctaggtggctaattttaaaacgtgtccagtgtgaggtgcagctggcggagtctgggggagcctggtacaggccggggggtcctgagactctcctgtgtagcctccggattcacctttagcagacatggcatgagctgggtccgcaggctccgaggggaaggggccgagtgggtgtcagtcattagtagtagtgtgatagaatttaccanaacagaactccgtgaacggggccncttcaccatcctatagagacaattccccaaanaacacactntactcagacaagtagacgtagacgagagacgacgacgacgacgactacttataactcgcgacgagtagtagttacggttcgacgaacggtacggtcgtacgtcgttacgtaacgttgtcg

SEQ ID NO: 373554 - DNA, 581 bp, Homo sapiens
  misc_feature: GZ8MTXP01EILZ8.22.82.H05.1.454.CMB.2.raw
  modified_base (520)..(520): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggaggtcgtggggggagcctggtacaggccggggggtcctgagactctcctgtgtagcctccggattcaccttagcagacatggcatgagcgtcggggtcccgccgaggcctacccgaagggggaacgggggccggaggtggggtgtcgagtcagtttagtagtagtggtgatagaatttaccactaacagctccgtagaacgggccgtcttcacctatcctactagaacgactaaacttcccaaagaaaccacactcgtaatcctagacaaagtgactaggcctagagacgccgaacgcacggcctaattactaacngcgacggaaagtatagttacgggttcaacgaacgggtgcgtacgtcgtttcctaaggctcg

SEQ ID NO: 373555 - DNA, 636 bp, Homo sapiens
  misc_feature: GZ8MTXP01AQPHB.22.82.H05.1.454.CMB.2.raw
  modified_base (573)..(573): a, c, t, g, unknown or other
  modified_base (577)..(577): a, c, t, g, unknown or other
  modified_base (614)..(614): a, c, t, g, unknown or other
  modified_base (628)..(628): a, c, t, g, unknown or other
  modified_base (632)..(632): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccggggggtccctgagactctcctgtgtagcctcgatctaccttagcagacatggcagtgagcgtcgggtccgccgaggcctccggagggggaacggggccggaggtggggtgtcgagtcgtagttagtaggtagtggtagtatagtaaactttacccaacaacacgtaaccgtccggtagggaaacgggccctccgttaccaaccctattcctacgtaaggaactaacctaaactttacccccgaaagaaaccctacgtaaccttaggtactacgtagaactaaaagtcgtaacgttaggccgtagaacggcgacccgaacgaccaccggtacctagttttanaacnggccgagaaggatacggttcgggttcagtaacgggtnccgtacgtcgtttnaagngtcg

SEQ ID NO: 373556 - DNA, 661 bp, Homo sapiens
  misc_feature: GZ8MTXP01CVHOL.22.82.H05.1.454.CMB.2.raw
  modified_base (284)..(284): a, c, t, g, unknown or other
  modified_base (286)..(286): a, c, t, g, unknown or other
  modified_base (288)..(288): a, c, t, g, unknown or other
  modified_base (290)..(290): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgtttctaggtggctattttaaaacgtgtcagtgtgaggtgcagctggcggagtcgtgggggagcctggtacaggccggggggtccctgagactctcctgtgtagcctccggattcacctttagcagacagngnangngcgtcggtcgcgcgcgcggaggggaggggcggaggtgggtgtcgtagtagtagttagtagtaggtaggtagtagtaagtaacttaaccaacaacacgtaacgtacgtacggaacgggaccgtcctactactactactacgtacgaacgaactaactaccaacgtaaactaactactacgtactacgtacgtaacaaacgtacgtaacgtaacggacgtacgaacgacgaccgaaccgaaccgtaaccgtaccgttaacgtttaacgttaacgtacgacggtaacggaacggtaaacgtaacggttaacgggttacggaacggtaaccgggtacggtaacgtacggttacgttacgtaacgttaacgtaacg

SEQ ID NO: 373557 - DNA, 546 bp, Homo sapiens
  misc_feature: GZ8MTXP01DDWYJ.22.82.H05.1.454.CMB.2.raw
  modified_base (179)..(179): a, c, t, g, unknown or other
  modified_base (301)..(301): a, c, t, g, unknown or other
  modified_base (391)..(391): a, c, t, g, unknown or other
  modified_base (404)..(404): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctattttaaaacgngtcagtgtgaggtgcagctggcggagtctggggggagcctggtacaggccgggggggtccctgagactctcctgtgtagcctccggattcacctttagcagacatggcatgagctgggtccnccaggctccagggggaaggggccggaggtgggtgtcagtcattagtagtagtggtgatagatttaccacaacagctcgtgaaaggggccncttcacatcttanagacacactacacaacacactatatctacacaagtacgtacgtagacgagagacgacgacgacgtacgactacttattaactcgcgacgagtagtagttacggttcgacgaacggtacgtcgtcgtcgttacgtcgttgtcg

SEQ ID NO: 373558 - DNA, 561 bp, Homo sapiens
  misc_feature: GZ8MTXP01DZRQG.22.82.H05.1.454.CMB.2.raw
  modified_base (177)..(177): a, c, t, g, unknown or other
  modified_base (272)..(272): a, c, t, g, unknown or other
  modified_base (274)..(275): a, c, t, g, unknown or other
  modified_base (277)..(279): a, c, t, g, unknown or other
  modified_base (281)..(281): a, c, t, g, unknown or other
  modified_base (311)..(311): a, c, t, g, unknown or other
tcagacatacgcgtcacgaccggtgctcgatttagtcgagctctctcgcggggtctgagagaggagcccagccctgggatttttcaggtgttttcatttggtgatcaggactgaacagagagaactcaccatggagtttgggctgagcggtgtgtttctaggtggctatttaaacgngtcagtgtgaggtgcagctggcggagtgtggggaggccgtggtacgagccgggggtcccgtgagactctcctgtgtagctcgatcaccttagcananngnnngngcgtcggcgcgcgcgcgagggacgggcggnggtggtgtgagtgtagttagtagtagtgtagtagtagtaactacacaacacgcgtacgtacggacggacgtctacactactctactagacgactactacacaacactactactactactacgacgaagtacgtacgtacgacgagagacgacgacgacgtacgtactacttataactcgacgagagtacgtacggttacggttacgacggtaacggtacgtaacgtacgtacgttacgtaacgttcgtcg

SEQ ID NO: 373559 - DNA, 543 bp, Homo sapiens
  misc_feature: GZ8MTXP01BGKZ3.22.82.H05.1.454.CMB.2.raw
  modified_base (297)..(297): a, c, t, g, unknown or other
  modified_base (363)..(363): a, c, t, g, unknown or other
  modified_base (396)..(396): a, c, t, g, unknown or other
  modified_base (412)..(412): a, c, t, g, unknown or other
  modified_base (421)..(421): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctagtggctattttaaacgtgtccagtgtgaggtgcagctggcggagtctgggggagcctggtacaggccggggggtccctgagactctctgtgtagcctccggattcacctttagcagacatggcatgagctgggtccncaggctccgaggggaggggccggagtgggtgtcagtcattagtagtagtgtgatagaatttaccanaacagctccgtgaagggccgcttcaccatcctnagacactaactccaanaacacactntactctagacaacgtagtagtagagagagacgacgacgacgtaccgactacttataactcgcgacgagagtacgttacggttcgacgtaacggtacggtcgtcgtcgttacgtaacgttgtg

SEQ ID NO: 373560 - DNA, 578 bp, Homo sapiens
  misc_feature: GZ8MTXP01DE79O.22.82.H05.1.454.CMB.2.raw
  modified_base (300)..(300): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccggggggtccctgagactctcctgtgtagcctccggattcacctttagcagacatggcatgagctgggtccnccaggctccgagggggaacgggggccggagtgggtgtcgagtcattagtagtagtggtcgatagaatttaccaactaacagctccgtagaaacggggccgcttcaccatctctagagacaattcccaagtaaccacactgtaatcctagacaaaagttcgaacgttagggcctagacgacgccgaacgacacggcctaatttactaactgacgacgaaaggtataagttacggggttcgaacgaacgggtgcgtaacgtcgtttactaaggaacttcg

SEQ ID NO: 373561 - DNA, 632 bp, Homo sapiens
  misc_feature: GZ8MTXP01C5WHB.22.82.H05.1.454.CMB.2.raw
  modified_base (176)..(176): a, c, t, g, unknown or other
  modified_base (276)..(276): a, c, t, g, unknown or other
  modified_base (283)..(283): a, c, t, g, unknown or other
  modified_base (288)..(288): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctattttaaaagngtcagtgtgaggtgcagctggcggagtcgtggggaggcgtggtacgaggccgggggtcccgtgagactctcctgtgtgcctccggattcacctttagcanacagtgnagtgngcgtcggccgcgacgcgacggacgggacggggcggaggtggtgtgtagtagtagttagtaggtaggtaggtagtaagtaagtaacttaaccaacaaacgtaacgtaacgtacgtacggtaacgggtaccgtaccgtacctacctactactacgtaacgaacgaacgtaactaaccgaacgaacaactactacgtactactacgtaactaagtaacgtaacgtacgtacgtagacgacgacgaacgacgtacgtactaacttataacgtacgacgacgaagtaagtaacgttacggttacgacggtaacggtacggtaacgtacgtacgttacgtaacgttgtcg

SEQ ID NO: 373562 - DNA, 621 bp, Homo sapiens
  misc_feature: GZ8MTXP01CVWQD.22.82.H05.1.454.CMB.2.raw
  modified_base (396)..(396): a, c, t, g, unknown or other
tcagacatacgcgtcacgaccggtgctcgatttagtcgagctctctcgcggggtctgagagaggagcccagccccgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggagcctggtacgaggccggggggtcctgagactctctgtgtagcctcggattcactttagcagacatggcatgagcgtgggtcccgcaggcctccgaggggacgggggccggaggtgggtgtcagtcagttagtagtagtggtgaatagtaattacacacaagactccgtagaacgggccncttcactatctactagaacgaactaacttaccccaagaaacaccgtacttaggtaatccgtagaacaaaagttgggaaaccgtagggtacctaggaacgacgcccgaacgaaccgacggtaccctaattttactacgtgacgacggaaaggttagtaacgtaccgggttacgacgaaccgggttggaccgttaacggttcgtttacgttagtaacgttcgtaacc

SEQ ID NO: 373563 - DNA, 567 bp, Homo sapiens
  misc_feature: GZ8MTXP01B264K.22.82.H05.1.454.CMB.2.raw
  modified_base (376)..(376): a, c, t, g, unknown or other
  modified_base (411)..(411): a, c, t, g, unknown or other
  modified_base (416)..(416): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggccgtggtacgaggccggggggtccctggagactctcctgtgtagcctccggattcacctttagcagacatggcatgagctgggtccgccaggcctccgagggggacggggccggaggtgggtgtcagtcagttagtagtagtggtgatagaatttaccanaaacagcgtcgtaggaacgggccgcttcacatctnaaganactaacttcccgaagaacacactgaactctagacaaagtcgactaggctagagcgcgaacgacgacggcctaattttactaactgaccggacgaaggtaatcggttacgggcaacgaagggtcgcttaacggtcgtttactaagcgttccg

SEQ ID NO: 373564 - DNA, 623 bp, Homo sapiens
  misc_feature: GZ8MTXP01EELIK.22.82.H05.1.454.CMB.2.raw
  modified_base (302)..(302): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggcttaattttaaaacgtgtccagtgtgaggtgcagctggcggagtcgtgggggagcctggtacaggccggggggtcctgagactctctgtgtagcctccggattcacctttagcagacatggcatgagcgtgggtccncgaggcctccggaggggaaggggccggaggtgggtgtcagtcattagtagtagtggtgatagtaatttaccacaacagtaacctccgtaggaacgggccgtcttcacctatcctactaagacgaactaacttaccccgaaagaaaccactactgtatctagacaaagttgaacttaggcagacgcgaccgaacgacgaccggtcctaatttacttaactcggcggaccggttaaagggtacttaacggttaccgggggttaccgaaccggtaaccggggtggtccttaaccgggtcgtttttaccgaaggttctttcccgg

SEQ ID NO: 373565 - DNA, 720 bp, Homo sapiens
  misc_feature: GZ8MTXP01AQUZA.22.82.H05.1.454.CMB.2.raw
  modified_base (299)..(299): a, c, t, g, unknown or other
  modified_base (331)..(331): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctaggtggctaattttaaaacgtgtcagtgtgaggtgcagctggcggagtcgtggggggagcctggtacaggccggggggtcctgagactctcctgtgtagcctccggattcacctttagcagacatggcatgagctgggccncaggctccgaggggaaggggccggagtgggtntcagtcagttagtagtagtggtcgatagtaaactttaccacaaacacgtaacttcccgggtaggaaacgggggtccccgtcttttaccaaccctaaacttcccggtttaaacgtaaacggaactaaccgtaaaccttaacccgtaaaccgaaaccaaacctaaccgttacgttacttacgtacgtaacgtaaacggtaacgtaacgtaacggtacgtacggtacgaacggaccgaaccgaaccgtaccggtaccgttaactttaacgttaacgtacggttacggacggttaaacggtaaacggtaacggttacgggttaccggttaaccggtaaccgggtacgggtaaccggttaccggttaccggtttaccgttaacgttaacgtccg

SEQ ID NO: 373566 - DNA, 625 bp, Homo sapiens
  misc_feature: GZ8MTXP01A979F.22.82.H05.1.454.CMB.2.raw
  modified_base (176)..(176): a, c, t, g, unknown or other
  modified_base (278)..(278): a, c, t, g, unknown or other
  modified_base (282)..(284): a, c, t, g, unknown or other
  modified_base (286)..(286): a, c, t, g, unknown or other
  modified_base (298)..(298): a, c, t, g, unknown or other
tcagacatacgcgtcacgaccggtgctcgatttagtcgagctctctcgcgggtctgagagaggagcccagccctgggattttcaggtgttttcatttggtgatcaggactgaacagagagaactcaccatggagtttgggctgagcgtgtgtttctaggtggctattttaaaacgngtcagtgtgaggtgcagctggcggagtctgggggaggccgtggtacgaggccgggggtcccgtgagactctcctgtgtagctccggatcacctttagcaganatgnnngngcgtcggcgcgngcgcgaggagggcggaggtggtgtgagtagtagttagtagtagtggtagtagtagtaacttacctacgaacacgtcgtacgtacggacggccgtaccgtactactactctacgtacgacgtaactaactaccgaacgaacactactacgtactactacgtacgaagtacgtacgtacgtacgtacgacgacggaccggaaccgaccgtaccgtaccgttaacgtttaacgttaacgtacgacggtacggaacggtaagtaacggttacgggttacggacggtaacggtacggtaacgtacggttacgttacgttaacgttaacgtcg

SEQ ID NO: 373567 - DNA, 617 bp, Homo sapiens
  misc_feature: GZ8MTXP01D5GGL.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggtcttaattttaaaacgtgtccagtgtgaggtgcagctggcggagtcgtgggggagccgtggtacgagggccgggggtcctgagactctcctgtgtagcctccggtattcaccttagcagacatggcatgagcgtcgggtcccgccgaggccgtaccggaagggggaacgggggccgggtaggtggggtgtcgagtctagttagtagtaggtggtagatagtaacttaccacaacagctcgtagaaacgccgcttcacatctactagacgactaacttacccaaagaaccactactagtactctagactaaagtgacgtagctagacgacgaccgaacgacgaccggtacctaatttactaacgtcgcggaacgttaaaggacttaacggaccggggttacaaaccgtaacggggtgtaaccgttaacggtcgttttacaaggttaacttccgg

SEQ ID NO: 373568 - DNA, 573 bp, Homo sapiens
  misc_feature: GZ8MTXP01DDIEG.22.82.H05.1.454.CMB.2.raw
  modified_base (177)..(177): a, c, t, g, unknown or other
  modified_base (277)..(278): a, c, t, g, unknown or other
  modified_base (280)..(282): a, c, t, g, unknown or other
  modified_base (284)..(284): a, c, t, g, unknown or other
  modified_base (316)..(316): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctaggtggctattttaaacgngtccagtgtgaggtgcagctggcggagtcgtgggggagcctggtacaggcccggggggtcctgagctctcctgtgtagcctccggatcaccttagcaganngnnngngcgtcggcgcgcgcgcggagggacggggcggnggtggtgtgtagtagtagttagtagtagtgtagtatagtaactaccacaacacgtcgtacggtacggacggccgcctacactactctactagacacactaccaacaacactactactactactacacaagtacgtacgtacgacgagagacgacgaccgacgtaccgtactacttagtaacgtcgacgacgaagtaacgtacggttacgggttacggacgaacggtcggtcgtacgtacgttacgtaacgttcgtcg

SEQ ID NO: 373569 - DNA, 606 bp, Homo sapiens
  misc_feature: GZ8MTXP01CUOM2.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggcttattttaaaacgtgtccagtgtgaggtgcagctggcggagtcgtgggggagcctgggtacaggccggggggtccctgagactctcctgtgtagcctccggattcacctttagcagacatggcatgagcgtgggtccgccgaggcctccgagggggaacgggggtccggaggtggggtgtcgagtctagttagtagtagtggtgatagaatttaccacaacagctccgtagaacgggccacttcaccatctactagacgacaacttccccgaataaaccacaacgttatactctagacaagtacgtacgtacgacgtacgagacgaccgaaccgaccgtaccgtacctacttattaacgtcgacgacggaaggtaacgtaagttacgggttacggacggtaacggtacggtaacgtcgtcgttacgtaacgttaacgtcg

SEQ ID NO: 373570 - DNA, 541 bp, Homo sapiens
  misc_feature: GZ8MTXP01EYLT1.22.82.H05.1.454.CMB.2.raw
  modified_base (302)..(302): a, c, t, g, unknown or other
  modified_base (394)..(394): a, c, t, g, unknown or other
  modified_base (438)..(438): a, c, t, g, unknown or other
  modified_base (442)..(442): a, c, t, g, unknown or other
  modified_base (449)..(449): a, c, t, g, unknown or other
  modified_base (498)..(498): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctaattttaaaacgtgtcagtgtgaggtgcagctggcggagtcgtgggggagcctggtacaggccgggggggtccctgagactctcctgtgtagcctccggattcacctttagcagacatggcatgagctgggtccnccaggctccgagggggaaggggccggagtggggtgtcaggtcattagtagtagtggtgatagaattaccacaacagctccgtgaacgggccncttacacctatcctatagacgactaacttcccaagaacacactntacnctagaanaagtagtagtagacgagagacgacgacgacgtacgactacttatctcgngagagagtagacggcgacgaagtgtcgtcgtcgttctgttgtg

SEQ ID NO: 373571 - DNA, 589 bp, Homo sapiens
  misc_feature: GZ8MTXP01C4JX7.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggagcctggtacgaggccgggggtcctgagactctcctgtgtacgcctccggtattcacctttagcagacatggcatgagcgtcgggtccgccgaggccgtccgagggggaacgggggccggtaggtgggtgtcgagtctagttagtagtagtggtgatagtaacttaccacaacagctcgtagaacgggccgcttcacatctactagagacattacccaagaacacactgtactctagacaaagtcgtactaggctagaacgacgacccgaagaccgtacggaccttaatttataacgtggacgacggaaagtactaggttacggttcgaaccgtaagggtacgtcgttaacggtcgtttacgtaagcgttaaccg

SEQ ID NO: 373572 - DNA, 543 bp, Homo sapiens
  misc_feature: GZ8MTXP01BQOUJ.22.82.H05.1.454.CMB.2.raw
  modified_base (390)..(390): a, c, t, g, unknown or other
  modified_base (405)..(405): a, c, t, g, unknown or other
  modified_base (421)..(421): a, c, t, g, unknown or other
  modified_base (431)..(431): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctatttaaacgtgtcagtgtgaggtgcagctggcggagtctgggggaggcctggtacaggccgggggggtcctgagactctcctgtgtagcctccggattcacctttagcagacatggcatgagctgggccgcaggctccgagggggaagggggccggaggtgggtgtcagtcagttagtagtagtggtgatagaattacacaacagaactccgagaacgggccncttcacctatcctanagacactactaccaanaacacacgtntatcgtacgacaagtagtacgtagacgagagacgacgacgacgtacgtactacttatctgcgacgagagtacgttacggcgacgaacggtcgtcgtcgtcgttactgttgtg

SEQ ID NO: 373573 - DNA, 624 bp, Homo sapiens
  misc_feature: GZ8MTXP01CJIT4.22.82.H05.1.454.CMB.2.raw
  modified_base (620)..(620): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagcctggtacgaggccgggggggtccctgagactctcctgtgtagcctccggattcacctttagcagacatggcatggagcgtcgggtcccgccgagggcctacccggaagggggaacgggggcccgggaggtgggggtgtcgagtctaagttagtagtaggtggtagaattagaactttaccaactaacaagctcccgtaggaaacgggccgtcttacaccatctactagacgacaaacttccccaagaaaccactacttagtactccgtagtaaccaaaaggttcggaaacctaggcctaggacgacgccgtaaacgcaaccggtcctaaagttttctaactggacgtacgaaagacttagaccgggttcaacgaacgggtgaactacggtcgtttacgaagngtcg

SEQ ID NO: 373574 - DNA, 557 bp, Homo sapiens
  misc_feature: GZ8MTXP01D8FG8.22.82.H05.1.454.CMB.2.raw
  modified_base (307)..(307): a, c, t, g, unknown or other
  modified_base (341)..(341): a, c, t, g, unknown or other
  modified_base (426)..(426): a, c, t, g, unknown or other
  modified_base (449)..(449): a, c, t, g, unknown or other
  modified_base (554)..(554): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggagccgtggtacgaggccggggggtccctgagactctcctgtgtacgcctccggattcacctttagcagacatggcatgagcgtgggtcccncaggctccgagggggaacggggccggagtgggtntcagtcattagtagtagtgtgatagaatttaccaacaacagtaactccggtaggaaacggggcccacttccaccatctctaaganacaacttcccaaagaacacactnaatctagacaaatgactaggctagacgacgcgaaccgacgacgctatttataactgccgagaagatagttacggttcaacgaaggtgcgtacgtctttactaagntcg

SEQ ID NO: 373575 - DNA, 591 bp, Homo sapiens
  misc_feature: GZ8MTXP01CWG5W.22.82.H05.1.454.CMB.2.raw
  modified_base (410)..(410): a, c, t, g, unknown or other
  modified_base (426)..(426): a, c, t, g, unknown or other
  modified_base (476)..(476): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggcttaattttaaaacgtgtccagtgtgaggtgcagcgtggcggagtcgtgggggagcctggtacgagggccggggggtccctgagactctcctgtgtagcctcggattcacctttagcagacatggcatgagcgtcgggtccgccgaggccgtccgagggggaacgggggccggaggtggggtgtcgagtctagttagtaggtagtggtacgatagtattaccacaacagctcgtagaacgggccnctcactatctataganacaattcccaagaaccacactgtactctagactaaagtcgaacgtaggcnggaacgacgacccggaacgaacgaccggacctaattttataaccgtgcggacgaaaggtatacgttacgggttcaaccgaagggtcggcgttacgtcgttttacaagttcgtccg

SEQ ID NO: 373576 - DNA, 557 bp, Homo sapiens
  misc_feature: GZ8MTXP01AONC2.22.82.H05.1.454.CMB.2.raw
  modified_base (305)..(305): a, c, t, g, unknown or other
  modified_base (381)..(381): a, c, t, g, unknown or other
  modified_base (507)..(507): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttgtggcttaattttaaaacgtgtccagtgtgaggtgcagctggcggagtcgtgggggagcctgggtacgagggccggggggtcctgagactctcctgtgtagcctccggattcacctttagcagacatggcatgagctgggtcccnccaggctccgagggggaaggggccggaggtggggtgtcgaggtcagttagtagtaggtggtgatagaatttaccanaacagctccggtagaacggggcctcttcaccatccttacagacgacaacttcccaagaaccacacctgtactctagacaaagttcgactaggctagagcgaccgacgacacggctatttataacgngacgagagatacgttcggcgacgaaggtcgcgtacgtcgttactgcgtcg

SEQ ID NO: 373577 - DNA, 651 bp, Homo sapiens
  misc_feature: GZ8MTXP01EJSP2.22.82.H05.1.454.CMB.2.raw
  modified_base (290)..(290): a, c, t, g, unknown or other
  modified_base (308)..(308): a, c, t, g, unknown or other
  modified_base (343)..(343): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctaatttaaacgtgtcagtgtgaggtgcagctggcggagtcgtgggggaggccgtggtacgaggccgggggtcccgtgagactctcctgtgtagctccggtactctaccttagcagacatggcangagctggtcgccgacgcnccgagggaggggccggaaggtgggtggtcgaggtnagttagtagtaagtggtgtagtagtaatttacacaaacacgaactcgtacgaagggccggcttcacaactcctcttaggagacaacttacccaacggaaactaacacctacgttaactacgtacgtacgtaaacggtacgtaacgtacgtacgtaggacggacggacggaaccgaaccgtaccgtaccgttaacgtttaacgttaacgtacggacggtacggttaaacggtaacgtaacggttacgggttaccggttaacggtaacgggtacggtaaccgttacgttacgttacgttaacgttcgtcg

SEQ ID NO: 373578 - DNA, 564 bp, Homo sapiens
  misc_feature: GZ8MTXP01BPCY1.22.82.H05.1.454.CMB.2.raw
  modified_base (398)..(398): a, c, t, g, unknown or other
  modified_base (500)..(500): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagcctggtacaggccggggggtccctgagactctcctgtgtagcctccggattcacctttagcagacatggcatgagcgtgggtccgccaggcctaccgagggggaacgggggccggagtgggtgtcgagtcattagtagtagtggtcgatagaattaccacaacagctccgagaacgggccncttcacatctactagacgacaacttcccaagtaaccacactagtatctagacaaagtgaactaggctaggacgacgccgaacgacacggactatttataacngcgcgaaaggataacgttacggggttcaacgaacgggtcgtctacggtcgtttacaagttctcg

SEQ ID NO: 373579 - DNA, 581 bp, Homo sapiens
  misc_feature: GZ8MTXP01BLEPC.22.82.H05.1.454.CMB.2.raw
  modified_base (359)..(359): a, c, t, g, unknown or other
  modified_base (410)..(410): a, c, t, g, unknown or other
  modified_base (457)..(457): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttaggtggctaattttaaaacgtgtccagtgtgaggtgcagctggcggagtcgtgggggagcctggtacaggccgggggggtcctgagactctcctgtgtagcctccggattcacctttagcagacatggcatgagctgggtccgcaggctccgaggggagggggccggaggtgggtgtcagtcattagtagtagtggtnatagaatttaccacaacagctccgtgaagggccgcttcaccatctctaganacaattcccaagaaccacactgtatctagacaaagtgaacgttaggntagacgacgaccgacgacgtacgtacttatttatcgcggacgaaggaaggtacgtaacgggttaccggggttcgaacggtaacgggtcggtaaccgttacggttcgtttacgtaacgttcgtcg

SEQ ID NO: 373580 - DNA, 898 bp, Homo sapiens
  misc_feature: GZ8MTXP01BQGPG.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagccgtggtacgaggccggggggtcctgacgactctcctgtgtagcctccggattcaccttagcagacatggcagtgacgtcgtcggggtccccgccgacgggtcctaccccggaaggggggtaaacggggggccccggggtaagggtttcggggggttacgttacccgtaaggttaccgtaaagttttaagggttaaggtttaaggttggggttaacgtaaagtttaaagggtaaaactttttaaaccccaacgtaaaaccgaaacggtaacccgttacccgggttaagggaaacgggggtcccccgtaccttttacccgaaacccgtacttcccgttaacgttaaacggtaaacgaaccgttaaaacctttacccccgaaaacgggtaaaaccctaccggtaaacctttagggtaaactttccgtaacgggtaacccttaaaaagggttacggtaaacccggtttaaggggacccgttaaggaaacggggaaccgggacccgggaaacccggaaacccgtaacccggggtaccccttaaaagtttttaaccggttaaacgtcgggaccggtaaaccggttaaagggtaaacttaaccggggttaacccggggttacgaaaccggtaaacccggggtggtaaccgttaaccggttccggttttacctaaggaacgtttccgg

SEQ ID NO: 373581 - DNA, 581 bp, Homo sapiens
  misc_feature: GZ8MTXP01BBEMN.22.82.H05.1.454.CMB.2.raw
  modified_base (367)..(367): a, c, t, g, unknown or other
  modified_base (523)..(523): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggagccgtggtacgagggccggggggtcctgagactctcctgtgtacgcctccggattcacctttagcagacatggcatgaacgtgggtccgccaggcctccgaggggaagggggccggaggtgggtgtcgagtcaagttagtagtagtggtnaatagtaaatttacccgacacgaaagacctccggtggaaacgggccgtcttaccaccattctactaagacgaacaacttcccaagaaaccacacttgaactctgacaaatggaacgttaggctagagacgccgacgtacacggtcctatttactcngcgacgaagatagtacgggcgacgaacggtgactaacgtcttcaggtaacttcggtcc

SEQ ID NO: 373582 - DNA, 619 bp, Homo sapiens
  misc_feature: GZ8MTXP01AZN48.22.82.H05.1.454.CMB.2.raw
  modified_base (297)..(297): a, c, t, g, unknown or other
  modified_base (299)..(299): a, c, t, g, unknown or other
  modified_base (330)..(330): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctaattttaaacgtgtcagtgtgaggtgcagctggcggagtcgtggggggagccgtgggtacgagggcccggggggtccctggacgactctcctgtgtacgcctccggattcacctttagcagacatggcangngcgtcggcgcgcgcgcggagggacgggcggnggtggtgtgtagtagtagttagtagtagtgtagtagtagtaactacacaacacgtcgtacgtacggacgggccgtcctacctactactactacgtagacgtaactaactaccaacaacactactactactactacgaacgtaacgtacgtaacgtacgtacgtagacgacgaccgacgacgtaccgtacttacttacttaacgtacgacggacggaacgtaacgtaacggttacgggttaccggacggtaacggtacggtaacgtacgttcgttacgtaacgttcgtcg

SEQ ID NO: 373583 - DNA, 568 bp, Homo sapiens
  misc_feature: GZ8MTXP01B6JBR.22.82.H05.1.454.CMB.2.raw
  modified_base (404)..(404): a, c, t, g, unknown or other
  modified_base (417)..(417): a, c, t, g, unknown or other
  modified_base (441)..(441): a, c, t, g, unknown or other
  modified_base (446)..(446): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctaattttaaaacgtgtcagtgtgaggtgcagctggcggagtcgtggggggaggcctggtacgaggcccgggggggtccctgagactctcctgtgtagcctccggattcacctttagcagacatggcatgagcgtgggtccgcgaggctccgagggggaaggggccggagtgggtgtcagtcattagtagtagtggtgatagaactttaccacaacagaactccgtaggaacgggccncttcaccatcctntagagacaacttcccaagaaccanaactntactcagacaagtagtagtagagagagacgacgacgacgacgactacttataactcgcgacgagtagtacgttacggttacgacgtaacggtacggtcgtacgtcgttacgtaacgttgtcg

SEQ ID NO: 373584 - DNA, 633 bp, Homo sapiens
  misc_feature: GZ8MTXP01DGTHT.22.82.H05.1.454.CMB.2.raw
  modified_base (278)..(278): a, c, t, g, unknown or other
  modified_base (280)..(280): a, c, t, g, unknown or other
  modified_base (284)..(284): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctatttaaacgtgtcagtgtgaggtgcagctggcggagtctgggggagcctggtacaggccggggggtccctgagactctcctgtgtagcctccggattcacctttagcagacangnatgngcgtcggccgcgacggcgcgaggggacggggcggaggtggtgtcgagtgtagttagtagtagtggtagtagtagtaacttaacctaacaaacacgtaacgtacgtacggaacgggaccgtctacacactctactagagaactaactaccaacgaacaactactagtactactacgtaactaaacgtacgtacgtacgtacgtagacgacgaccgaaccgaccgtaaccgtaccgttaactttaacttaacgtacgacggtacggaaacggtaacgtaacggttaacgggttacggttaacggtaacggtacggtaacgttacgttacgtttacgttaacgttaacgtcg

SEQ ID NO: 373585 - DNA, 546 bp, Homo sapiens
  misc_feature: GZ8MTXP01DD610.22.82.H05.1.454.CMB.2.raw
  modified_base (151)..(151): a, c, t, g, unknown or other
  modified_base (175)..(175): a, c, t, g, unknown or other
  modified_base (296)..(296): a, c, t, g, unknown or other
  modified_base (335)..(335): a, c, t, g, unknown or other
  modified_base (386)..(386): a, c, t, g, unknown or other
  modified_base (402)..(402): a, c, t, g, unknown or other
  modified_base (419)..(419): a, c, t, g, unknown or other
  modified_base (436)..(436): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgngtttctaggtggctatttaaacgngtccagtgtgaggtgcagctggcggagtcgtgggggagcctggtacaggccggggggtccctgagactctcctgtgtagcctccggattcaccttagcagacatggcatgagctgggtccnccaggctccgaggggaaggggccggagtgggtgtctagnattagtaagtgtggtgatagtatttacacaacagctccgtaggaagggccncttacaccatccttanagacactactaccgaanacactactagtactcanacaagtagtacgtagacgagagacgacgacgacgtacgactacttataactcgacgacgagagtagttacggcgacgtaacggtcgtcgtcgtacgttactaagttgtcg

SEQ ID NO: 373586 - DNA, 635 bp, Homo sapiens
  misc_feature: GZ8MTXP01DAH85.22.82.H05.1.454.CMB.2.raw
  modified_base (481)..(481): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtggggggaggcctgggtacgagggcccgggggggtccctggagactctcctgtgtagcctccggattcaccttagcagacatggcatgagcgtcgggtccgccgaggctccggagggggaacgggggccggaggtgggtgtcgaggtctagttagtagtagtggtacgataagtaatttaaccacaaacagtaactcggtaggaacggggcctacttcacatctatagacactaacttacccaagaaccacactgtaatctagacaaagtnaacgtaggctagacgacgcccgaacgaccaacggcctaagttttactaaccgtaggaccggtaacggaaaggtaagtacggttaacccgggggttcgaaaccggtaacggggttgtaaccgttaccggttccgtttacgtaagttaacgttccg

SEQ ID NO: 373587 - DNA, 615 bp, Homo sapiens
  misc_feature: GZ8MTXP01AKHCM.22.82.H05.1.454.CMB.2.raw
  modified_base (222)..(222): a, c, t, g, unknown or other
  modified_base (273)..(274): a, c, t, g, unknown or other
  modified_base (276)..(278): a, c, t, g, unknown or other
  modified_base (280)..(280): a, c, t, g, unknown or other
  modified_base (318)..(318): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctaggtggctatttaaacgtgtcagtgtgaggtgcagctggcggagtcgtgggggagcctggtacnggccggggggtcctgagctctctgtgtagcctccggattcacttagcaganngnnngngcgtcggtccgcgacgcgacggaggggacggggacggnggtggtgtcgtagtagtagttagtagtaggtggtagtagtagtaacttacacaacacgcgtacggtacggacggccgtactacactactactacgtagacactaactaccaacgaacactactacgtactactacgaactaaggtacgtacgtacgtacgtacgacggacgaccggaaccgaccgtaccgtacgttaacttaacgttaacgtacgacggtacggaaggtaacgtaacggttacggttacggacggtaacgggtacggtaacgtacgtacgttacgtaacgttcgtcg

SEQ ID NO: 373588 - DNA, 579 bp, Homo sapiens
  misc_feature: GZ8MTXP01BJZ81.22.82.H05.1.454.CMB.2.raw
  modified_base (444)..(444): a, c, t, g, unknown or other
  modified_base (452)..(452): a, c, t, g, unknown or other
  modified_base (471)..(471): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctattttaaacgtgtccagtgtgaggtgcagctggcggagtctgggggaggcctggtacaggccgggggggtccctggagactctcctgtgtagcctccggattcacctttagcagacatggcatgagctgggtccgcaggctccgagggggaaggggccggaggtggggtgtcaggtcagttagtagtagtggttgatagaatttaccacaacagaactccgtaggaacgggccacttcaccatctactaggacactaaattcccaagaacacactntactctanacaagtagtacgtagacgngagacgacgaccgacgtaccgactacttataacgtcgcgacgaaggagtagttacgggttacggacggaacggtacggtcgtacgtacgttacgttaacgttaagtcg

SEQ ID NO: 373589 - DNA, 645 bp, Homo sapiens
  misc_feature: GZ8MTXP01C85GX.22.82.H05.1.454.CMB.2.raw
  modified_base (286)..(286): a, c, t, g, unknown or other
  modified_base (288)..(288): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctagtggcttaattttaaaacgtgtcagtgtgaggtgcagctggcggagtcgtgggggagcctggtacgaggccggggggtcctgaagctctcctgtgtagcctccggattcaccttagcagacatggnangagcgtcggccgcgacgcgacggagggacggggcggaggtggtgtcgtagtagtagttagtaggtagtagtacgtagtaagtaactaactaacgaaacgacgtaacgtacgtacggacggaccgtaccgtactactactactacgtaacgaacgtaactaacctaaccaacaactaactactacgtactactacgtaactaaacgtaacgtaacgtacgtacgtacgaacgacgaccgaaccgacgtaccgtaccgttaacttaacttaacgtacgacggaacgaacggtaacgtaacggttacggttacggacggtaacggtacggtaacgtacgtacgttacgtaacgttcgtcg

SEQ ID NO: 373590 - DNA, 552 bp, Homo sapiens
  misc_feature: GZ8MTXP01A6SFT.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggagcctggtacaggcccggggggtccctgagactctcctgtgtagcctccggattcacctttagcagacatggcatgagctgggtccgccgaggctccgagggaacggggccggagtgggtgtcagtcagttagtagtagtggtgatagaatttaccacaacagctcgtgaacgggccgcttcaccatctcagagacaattacccagaacacactagtactctagaccaaagtcgactaggctagagacgccgaacgaccacggctagtttataactgcgacgaaggatagttacgggttcgacgaagggtcggctacggtctttcgtaacgaagttccg

SEQ ID NO: 373591 - DNA, 632 bp, Homo sapiens
  misc_feature: GZ8MTXP01DSGC5.22.82.H05.1.454.CMB.2.raw
  modified_base (302)..(302): a, c, t, g, unknown or other
  modified_base (402)..(402): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttgtggcttaattttaaaacgtgtccagtgtgaggtgcagctggcggagtcgtgggggagcctggtacgaggccggggggtccctgagactctcctgtgtagcctcggattcacctttagcagacatggcatgagctgggtccnccaggcctccgaagggggaacggggccggagtgggtgtcagtcagttagtagtagtggtagataagtaatttacccacaacagctccgtagaacgggccncttcaaccatctactaagacgacaaacttccccaaagaaacactactgtaatcctagaaacaaagtagtaacgtacgacgtagacgacgaccgaaccgaaccgtaccgtaccgttaacttaacttaacgtacgacggaacgaaacggtaaacgtaacggttaacgggttaccggttaaccggtaacggtacggtaacgtaccgttacgttacgttaacgttaacgtaacg

SEQ ID NO: 373592 - DNA, 571 bp, Homo sapiens
  misc_feature: GZ8MTXP01B2YI1.22.82.H05.1.454.CMB.2.raw
  modified_base (410)..(410): a, c, t, g, unknown or other
  modified_base (481)..(481): a, c, t, g, unknown or other
  modified_base (566)..(566): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccggggggtccctgagactctcctgtgtagcctccggattcacctttagcagacatggcatgagcgtcgggtcccgccgaggcctccggagggggaacgggggccggaggtggggtgtcgagtcagttagtagtagtggtagatagtaatttaccacaaacagaactcgtagaacgggccncttcaccatctctaagacgacaacttcccaagaaccacactgtatctagacaaagtgaactaggctagagngaccgacgactacggctatttataactgcgacgaaggtatagttacgggttcgaacgaacggtggcctacggtcgtttactaagngttcg

SEQ ID NO: 373593 - DNA, 567 bp, Homo sapiens
  misc_feature: GZ8MTXP01DSNOF.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggagcctggtacaggccggggggtccctgagactctcctgtgtagcctccggattcacctttagcagacatggcatgagctgggtccgccaggctccgagggggaacggggccggagtgggtgtcagtcattagtagtaggtggtcgatagtaatttacccacaacagcgtccgtagaaacgggccgcttcaccatctacgtagacgacaacttcccaagtaacacactgtaatctagacaaagtcgaactagggctagacgacgtaccgaacgacaccggtcctaagtttactaactgcgacgaaaggtatagacggggttcacgaacgggtgctacggctttactaagaagtcg

SEQ ID NO: 373594 - DNA, 550 bp, Homo sapiens
  misc_feature: GZ8MTXP01EPCHX.22.82.H05.1.454.CMB.2.raw
  modified_base (445)..(445): a, c, t, g, unknown or other
  modified_base (547)..(547): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttctagtggctattttaaacgtgtccagtgtgaggtgcagctggcggagtcgtgggggagcctggtacaggccggggggtcctgagactctcctgtgtagcctccggattcaccttagcagacatggcatgagcgtgggtccgcaggctccgagggggaacgggggccggaggtgggtgtcagtcagttagtgtagtgtgatagaatttaccacaacagtaactcgtagaacgggccgtcttacacatctactagagacaacttcccaagaacacaacgttatactctanacaagtagtacgtacgacgtagagacgaccgacgacgacgactacttataactcgcgacgagagtacgttacggcgacgaacgtgtcgtcgtcgttcgtcgngtg

SEQ ID NO: 373595 - DNA, 668 bp, Homo sapiens
  misc_feature: GZ8MTXP01CUQIM.22.82.H05.1.454.CMB.2.raw
tcagacatacgcgtcacgaccggtgctcgatttagtcgagctctctcgcggggtctgagagaggagcccagccctgggattttcaggttgttttcatttggtgatcaggactgaacagagagaactcaccatggagtttgggctgagctggtctttttcttgtggtcttaattttaaaacgtgtccagtgtgaggtgcagctggcggagtcgtgggggagccgtggtacgagggccgggggtcctgacgactctccgtgtcgtacgccgtcggattcacctttgcagacatggacagtgacgcgtcgggccgaccgaggccgtaccggaagggggaacgggggccggtaggtggggtcgtacgaggtactagtttaagtaggtagtggtacgtaatagtaaactttaccaactaacgaacgtaaccgttccggtaagggaaacggggtccctaccgtttaccaaactacttctactaagaacgtaactaaacttacccgaaagaaacctactaacttagtaactcgtacgaactaaagtcgaaaccgttagccgtagaacgacgaccgaacgactacggtaccttaatttagtaaccgtaggcggtaacgaaaggtactaaggttcggttacaaccgtaaggcgtcgtacgtcttaccgtaagcttcg

SEQ ID NO: 373596 - DNA, 535 bp, Homo sapiens
  misc_feature: GZ8MTXP01EE1XZ.22.82.H05.1.454.CMB.2.raw
  modified_base (300)..(300): a, c, t, g, unknown or other
  modified_base (334)..(334): a, c, t, g, unknown or other
  modified_base (500)..(500): a, c, t, g, unknown or other
  modified_base (503)..(503): a, c, t, g, unknown or other
  modified_base (527)..(527): a, c, t, g, unknown or other
  modified_base (531)..(531): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggagcctggtacaggccggggggtccctgagactctcctgtgtagcctccggattcacctttagcagacatggcatgagcgtgggtccnccaggctccgaggggaacggggccggagtgggtntcagtcattagtagtaggtggtagatagaactttaccacaacagctccgtagaacgggccgctcactatctctaagagacaacttacccaagaaccacactgatctagacaaagtgactaggctgagacgccgaacgacacggactatttataactgcgagaaagntanacgggcacaacggtgctagctttnaagngtcg

SEQ ID NO: 373597 - DNA, 557 bp, Homo sapiens
  misc_feature: GZ8MTXP01DNLS2.22.82.H05.1.454.CMB.2.raw
  modified_base (298)..(298): a, c, t, g, unknown or other
  modified_base (352)..(352): a, c, t, g, unknown or other
  modified_base (366)..(366): a, c, t, g, unknown or other
  modified_base (390)..(390): a, c, t, g, unknown or other
  modified_base (434)..(434): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttctgtggctattttaaacgtgtccagtgtgaggtgcagctggcggagtcgtgggggagcctggtacaggccggggggtccctgagactctcctgtgtagcctccggattcacctttagcagacatggcatgagctgggtccncaggctccgaggggaaggggccggagtgggtgtcagtcattagtagtagtggtnatagaatttaccanaacagaactccgtagaacgggccncttcacatctctagagacaattcccaagaacacactgtatctanacaagtcgagtagcgagagcgaccgacgacgtacgtactatttataacgtgacgacgaagtacgtaacggttacgggttcgaacggtaacgggtcgtcgttacgtcgttacgtaagttcgtcg

SEQ ID NO: 373598 - DNA, 564 bp, Homo sapiens
  misc_feature: GZ8MTXP01CAMCK.22.82.H05.1.454.CMB.2.raw
  modified_base (373)..(373): a, c, t, g, unknown or other
  modified_base (408)..(408): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctattttaaaacgtgtcagtgtgaggtgcagctggcggagtcgtgggggagcctggtacaggccggggggtcctgagactctcctgtgtagcctccggattctaccttagcagacatggcatgagcgtcgggtccgcaggctccggagggggacggggccggaggtgggtgtcgagtcagttagtagtagtggtgatagtattaccanaacagctccgtagaacgggccgcttacacatcctntaagacgactaacttcccaaagaaccacactgtactcgtagacaagtacgtacgtagtacgtacgagacgacgacgacgacgacgtacttataactcgcgacgagagtagttacggttcgacgaacggtacggtcgtacgtcgttcgtcgttgtcg

SEQ ID NO: 373599 - DNA, 589 bp, Homo sapiens
  misc_feature: GZ8MTXP01B0AZ9.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttgtggctaattttaaaacgtgtccagtgtgaggtgcagctggcggagtcgtgggggaggcctggtacgaggccgggggggtccctgagactctcctgtgtagcctccggattcacctttagcagacatggcatgagcgtggggtcccgccaggcctccgagggggaacgggggccggaggtggggtgtcagtcagttagtagtagtggtgatagaatttaccataacagctccgtagaacgggccgcttcacctatctctagagacaacttcccaagaaccacactagtatctagacaaagtcgaactagggctagagcgacccgaacgtacaccggtacctatttactaacgtgacgacggaaaggatacgttacgggttcgaaccgtaacgggtcggtaactacggtcggtttctaaggttaatccgg

SEQ ID NO: 373600 - DNA, 614 bp, Homo sapiens
  misc_feature: GZ8MTXP01DNUR2.22.82.H05.1.454.CMB.2.raw
  modified_base (500)..(500): a, c, t, g, unknown or other
  modified_base (518)..(518): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggaggtcgtgggggagcctggtacgaggccggggggtcctgagactctcctgtgtagcctccggattcacctttagcagacatggcatgaacgtcgggtcccgcaggcctccggaggggaagggggccggaggtgggtgtcgagttcagttagtagtaggtggtagatagtaactttaccacacaagactccggagaaccgggcctcttaccaccgtatcctactagagactaacgttcccaaagaaccactactgtactctgaacaatggaactaggctagagacgccgacgaacnccgtcctaatttacgtcncggtcgacggaaacggattacggtaccgggttaccggaccgttaaacggggtcgtacccttaacggttccgtttacgagttaacgttcggttcccg

SEQ ID NO: 373601 - DNA, 564 bp, Homo sapiens
  misc_feature: GZ8MTXP01AIARN.22.82.H05.1.454.CMB.2.raw
  modified_base (382)..(382): a, c, t, g, unknown or other
  modified_base (415)..(415): a, c, t, g, unknown or other
  modified_base (420)..(420): a, c, t, g, unknown or other
  modified_base (438)..(438): a, c, t, g, unknown or other
  modified_base (491)..(491): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctagtggctatttaaacgtgtcagtgtgaggtgcagctggcggagtcgtggggggaggcctgggtacaggccgggggggtcctgagactctcctgtgtagcctcggattcaccttagcagacatggcatgagctggggtcccgccgaggctccgagggggaacgggggccggaggtgggggtgtcaggtcagtttagtaggtagtggtacgatagtaatttaccanaacagctcgtagaagggccgcttcaccatcctntaganacattaccagacacactntatcagacaaatgatagctgagcgacgacgacacggacctatttacttaactnccggggggaaacaaggtagtacggttacgggcgacggtaacggtcggtaacgtacgtcgttacgtgttcgtcg

SEQ ID NO: 373602 - DNA, 537 bp, Homo sapiens
  misc_feature: GZ8MTXP01D598S.22.82.H05.1.454.CMB.2.raw
  modified_base (296)..(296): a, c, t, g, unknown or other
  modified_base (363)..(363): a, c, t, g, unknown or other
  modified_base (368)..(368): a, c, t, g, unknown or other
  modified_base (400)..(400): a, c, t, g, unknown or other
  modified_base (442)..(442): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcttttctagtggctatttaaacgtgtccagtgtgaggtgcagctggcggagtcgtgggggagcctggtacaggccggggggtcctgagactctcctgtgtagcctccggattcacctttagcagacatggcatgagctgggtccncaggctccgaggggaggggccggagtgggtgtcagtcattagtagtagtggtgatagaatttaccanaacanctcgtgaaagggccgcttcaccatctctaganacaacttcccaagaacacactgtatctagacaatagatagcngagagcgacgacgacggacctacttattaactgcgcgaagagtaagttacggttcggacgaaccggtaggcgtacgtcggttactaagttaatcg

SEQ ID NO: 373603 - DNA, 575 bp, Homo sapiens
  misc_feature: GZ8MTXP01DANPN.22.82.H05.1.454.CMB.2.raw
  modified_base (318)..(318): a, c, t, g, unknown or other
  modified_base (328)..(328): a, c, t, g, unknown or other
  modified_base (347)..(347): a, c, t, g, unknown or other
  modified_base (395)..(395): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggcttttcttagtggctattttaaaacgtgtccagtgtgaggtgcagctggcggagtctgggggagcctggtacagccgggggggtccctgagactctcctgtgtagcctccggattcacctttagcagacatggcatgagctggtcgccagctccaggagggcggagnggtgtcagtnatagtagtagtgtgagtanaatttacacaacagaactccgtgaagggacgctcacactctctaaganacactacaacaacacactagtactactacgacaaacgtaacgtaacgtaacgtacgtagagacgaccgaaccgaacgtaccgtactacttaacttaactacgacgacgaaggtaagtaagttacggttacggaacgtaacggtacggtaacgtacgtacgttacgttaacgttaacgtcg

SEQ ID NO: 373604 - DNA, 545 bp, Homo sapiens
  misc_feature: GZ8MTXP01BHM7G.22.82.H05.1.454.CMB.2.raw
  modified_base (474)..(474): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccggggggtccctgagactctcctgtgtagccttcggattcacctttagcagacatggcatgagctgggtccgccaggctccgaggggaggggccggagtgggtgtcagtcattagtagtagtggtgatagatttaccacaacagctcgtgaacgggccgcttcacatctctagagacaattcccaagaacacactgtatctagacaaagtgaactaggctagagcgcgacgactacggcctatttntaactgcgcgaaggtatagttacggggttcaacgaacgggtggaaccgtcgtcgtttcctaagaagttccg

SEQ ID NO: 373605 - DNA, 574 bp, Homo sapiens
  misc_feature: GZ8MTXP01B33H0.22.82.H05.1.454.CMB.2.raw
  modified_base (385)..(385): a, c, t, g, unknown or other
  modified_base (404)..(404): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagcctgggtacgaggcccggggggtcctgagactctcctgtgtacgcctccggtattcacctttagcagacatggcatgagcgtcgggtccgccgaggcctccggagggggacgggggccggaggtgggtgtcgagtctagttagtagtagtggtgatagaatttaccanaacagctcgtgacgggccncttcacatctctagagacaacttcccaagaacacactgtactctagacaaagtgacgtaggctagagacgaccgacgactacggcctaatttactaacgtgacggacgaaggtataggttacgggttcgaacgtaacgggtcgcctacggtcgttactaagttaactccg

SEQ ID NO: 373606 - DNA, 600 bp, Homo sapiens
  misc_feature: GZ8MTXP01A4C0Q.22.82.H05.1.454.CMB.2.raw
  modified_base (503)..(503): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggccgtgggtacgagggccggggggtcctgagactctcctgtgtagcctccggattcacctttagcagacatggcatgagcgtcggggtccgccgaggcctccggagggggaacgggggccgggaggtggggtgtcgagtctaagttagtagtaggtggtagatagtaactttaccacaaacagctccgtggaacgggccgcttacactatcctatagacgactaacttcccaagaacacactagtactcgtagacaaagtgacgtaagctagagcgaccgacgacnccggtacctatttactaacgtcgacggtaccgaaggtatacggttacgggttcgaacggtaacgggtgcgttacggtcgtttactaacgaagttccg

SEQ ID NO: 373607 - DNA, 658 bp, Homo sapiens
  misc_feature: GZ8MTXP01CPSNH.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggtcttattttaaaacgtgtccagtgtgaggtgcagctggcggagtcgtgggggaggcctggtacgagggccggggggtccctgagactctcctgtgtagcctccggattcacctttagcagacatggcatgagcgtcggggtcccgccgagggcctaccggaagggggaacggggggcccggaggtggggtgtcgaggtctagttaggtagtaggtggtagataagtaatttaccacaaacagaacgtccggtaggaaacggggcctccgttacaccaaactccttactaagacgtaccaaacttccccaagaaaccaacacttagtactcgtagaacctaaagtgtaacgtaggctagacgacgccgaacgacgtacggaccttaatttctaacgtcggacgtaccggaaaggtaacgtaacggttaccggggttacgaacggtaaccgggtgggtaacccgtacggttcgtttaccgtaagttaagtttcccg

SEQ ID NO: 373608 - DNA, 602 bp, Homo sapiens
  misc_feature: GZ8MTXP01BUOZY.22.82.H05.1.454.CMB.2.raw
  modified_base (464)..(464): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttctgtggcttattttaaaacgtgtccagtgtgaggtgcagctggcggagtcgtgggggaggcctggtacgaggccggggggtccctggagactctcctgtgtagcctccggattcacctttagcagacatggcatgagcgtcgggtccgccgaggccgtacccggagggggaaacgggggcccggaggtggggtgtcgagtcgattagtagtagtggtgatagtaattaccactaaacagaacgtccgtaggaacggggcctacttcactactctactaaggacactaacttcccaaagaacacactntaatctagacaaagtcgaactaaggctagagacgccgacgacgaccgtacctaatttactaacgtgaccggacgaagggatacggttacgggcaacgtaacgggttcggcgttaccgtacggtttctaagttcgtccg

SEQ ID NO: 373609 - DNA, 619 bp, Homo sapiens
  misc_feature: GZ8MTXP01BSFL6.22.82.H05.1.454.CMB.2.raw
  modified_base (292)..(292): a, c, t, g, unknown or other
  modified_base (325)..(325): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctagtggctaatttaaacgtgtcagtgtgaggtgcagctggcggagtcgtgggggagcctggtacaggccggggggtcctgagctctcctgtgtagcctccggattcaccttagcagcatggcatgagctgggccncaggctccgagggggacgggccggagtggggtntcagtctagttagtagtgtggtacgatagtaacttaccacaacgacgtccgtcggtaggacgggcctctacactatctagtagacactactaccaacgaacactactagtactactacgtaactaacggtacgtaacgtacgtacgtacgacgaccgaccgtaccgtaccgtaccgtaccttactttacgttaacgtacgttacggtacggaaacggtaacgtaacggttacgggttacggttaacggtaacggtacggtaacgtacggttacggttacgtaacgttaacgtcg

SEQ ID NO: 373610 - DNA, 534 bp, Homo sapiens
  misc_feature: GZ8MTXP01D3Z5U.22.82.H05.1.454.CMB.2.raw
  modified_base (150)..(150): a, c, t, g, unknown or other
  modified_base (173)..(173): a, c, t, g, unknown or other
  modified_base (393)..(393): a, c, t, g, unknown or other
  modified_base (396)..(396): a, c, t, g, unknown or other
  modified_base (398)..(398): a, c, t, g, unknown or other
  modified_base (407)..(407): a, c, t, g, unknown or other
  modified_base (421)..(421): a, c, t, g, unknown or other
  modified_base (423)..(423): a, c, t, g, unknown or other
tcagacatacgcgtcacgaccggtgctcgatttagtcgagctctctcgcgggtctgagagaggagcccagccctgggattttcaggtgttttcatttggtgatcaggactgaacagagagaactcaccatggagtttgggctgagcgtgngtttctaggtggctatttaaagngtccagtgtgaggtgcagctggcggagtctgggggagcctggtacagccggggggtcctgagactctcctgtgtagcctccggattcacctttagcagacatggcatgagctggtccgccaggctccaggggaagggggccgggaggtgggtgtcgagtgattagtagtagtggtgatagtaattacacaacagaactccgtgaaggcgctcaccatctntananacactacanacacacatatctananaagtagtatagacgtgagagacgacgacgacgactacttataactgcgacgaggtagtagttacggttcggacgaacggtacggtaacgtacgtcgttacgtaagttgtcg

SEQ ID NO: 373611 - DNA, 643 bp, Homo sapiens
  misc_feature: GZ8MTXP01DY5MC.22.82.H05.1.454.CMB.2.raw
  modified_base (284)..(284): a, c, t, g, unknown or other
  modified_base (308)..(308): a, c, t, g, unknown or other
  modified_base (372)..(372): a, c, t, g, unknown or other
  modified_base (390)..(390): a, c, t, g, unknown or other
  modified_base (462)..(462): a, c, t, g, unknown or other
tcagacatacgcgtcacgaccggtgctcgatttagtcgagctctctcgcgggtctgagagaggagcccagccctgggatttttcaggtgtttttcatttggtgatcaggactgaacagagagaactcaccatggagtttgggctgagcgtggtcgttttctagtggctatttaaacgtgtcagtgtgaggtgcagcgtggcggagtcgtggggagccgtggtacgaggtccgggggtcctgacgactctcctgtgtagcctccgtattcgtacctttagcaganagtggctagtgagcgtcgggtccncgaggcctaccggaggggaacggggccggagtgggtgtcagtcgtagttagtagtaggtggtanaagtagtaattaccgaanaacgacgaacgtccggtaggaaacgggtccctacttcacctatccctagtaggactaacaacttacccgaanaacactaaccttgtaactactacgactaaagtcgaacgtagacgtagacgacgaccgtaaccgaccgtacgtacttacttacgtaacgcggaccggtaaaggaaagtaacgtaacggttaccgggttacgaaccgggtaacggtacgtaacgttacggtacgtttacgtaacgttcgtccg

SEQ ID NO: 373612 - DNA, 608 bp, Homo sapiens
  misc_feature: GZ8MTXP01EEICG.22.82.H05.1.454.CMB.2.raw
  modified_base (303)..(303): a, c, t, g, unknown or other
  modified_base (402)..(402): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggtcttaattttaaaacgtgtccagtgtgaggtgcagcgtggcggagtcgtgggggagccgtggtacaggccgggggtcctgagctctcctgtgtagcctcggtattcacctttagcagacatggcatgagcgtgggtccncgaggcctccggaggggaacggggccggaggtgggtgtcagtctagttagtagtaggtggtcgatagtaacttaccacaacagctccgtagacgggccncttcactatctactagagacaacgttacccaagaacacactagtactctacgactaaagtcgtaacgtacggactagaagaccgaccggaacgaccgaccggtacctaagttttaactaacttggacgtaacggaaaggtacgtaacgttaccggggttcgaacgtaacgggtgtccgtacgtcgtttacgtaagttaacgttccg

SEQ ID NO: 373613 - DNA, 568 bp, Homo sapiens
  misc_feature: GZ8MTXP01AOEKC.22.82.H05.1.454.CMB.2.raw
  modified_base (300)..(300): a, c, t, g, unknown or other
  modified_base (418)..(418): a, c, t, g, unknown or other
  modified_base (430)..(430): a, c, t, g, unknown or other
  modified_base (436)..(436): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttctgtggctattttaaaacgtgtccagtgtgaggtgcagctggcggagtcgtgggggagcctgggtacaggccgggggggtccctggagactctcctgtgtagcctccggattcacctttagcagacatggcatgagctgggtccncaggcctccgagggggaaggggccggaggtgggtgtcagtctattagtagtagtggtgatagtaatttaccgacaacagaacgtccgtaggaacggggcctctacacctatctcaganacattcccgaanaacacnctgtatctagacaaagtgactaggcagagacgccgacgactaccggacctattataacgtgccgagaaggtactagttacgggcgaacgtaaccgggtgaaccgtaaccgtccggttttactaagttcgtcg

SEQ ID NO: 373614 - DNA, 614 bp, Homo sapiens
  misc_feature: GZ8MTXP01EV6LG.22.82.H05.1.454.CMB.2.raw
  modified_base (312)..(312): a, c, t, g, unknown or other
  modified_base (560)..(560): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtggggggagccgtggtacgacgggcccgggggggtccctggacgactctcctgtgtacgcctccggattcacctttagcagacatggcatgagcgtgggccncgaggctccgagggggaggggccggaggtgggtgtcagtcagttagtagtagtggtagataagtaactttaccaacaacagctccggtagaacgggcctcttacactattcctactaggaacactaacttcccaaagaaccacgactgtactctagactaaaggtcgaacgtggctagacgacgccgaacgacgtaccggtacttaatttacgaactggaccgacgaaaggataacggttaccggggngaaaccgtaacggggtgaacctttaacggtcgttttacgtaagttaacgttccg

SEQ ID NO: 373615 - DNA, 623 bp, Homo sapiens
  misc_feature: GZ8MTXP01C56A8.22.82.H05.1.454.CMB.2.raw
  modified_base (308)..(308): a, c, t, g, unknown or other
  modified_base (620)..(620): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcgggagtcgtgggggaggcctggtacgaggccgggggggtccctggagactctcctgtgtagcctccggattcacctttagcagacatggcatgagcgtcgggtccnccgaggcctaccggaagggggaacgggggccggaggtggggtgtcaggtctagttagtagtagtggtagactagtaactttaccaacaaacagtaaccgtccggtaggaaacggggccctaccgttacacctactctacctagaacgacctaaattaccccaagaaccactactagtaatctagaactaaagtcgaacgttaaggctaggaacgacgaccggaacgtactaaccggcctatttataacgtgcgacgaaagggtataagttacgggttcaaccgaagggtgaacttacggtctttacgtaagntcg

SEQ ID NO: 373616 - DNA, 593 bp, Homo sapiens
  misc_feature: GZ8MTXP01DTJDF.22.82.H05.1.454.CMB.2.raw
  modified_base (192)..(192): a, c, t, g, unknown or other
  modified_base (255)..(255): a, c, t, g, unknown or other
  modified_base (282)..(282): a, c, t, g, unknown or other
  modified_base (284)..(284): a, c, t, g, unknown or other
  modified_base (286)..(286): a, c, t, g, unknown or other
  modified_base (300)..(300): a, c, t, g, unknown or other
tcagacatacgcgtcacgaccggtgctcgatttagtcgagctctctcgcggggtctgagagaggagcccagccctgggatttttcaggtgtttttcatttggtgatcaggactgaacagagagaactcacatggagtttgggctgagcgtgtcgttttctagtggctaatttaaacgtgtcagtgtgaggtncagctggcggagtcgtggggagcctggtacaggccggggggtcctggagactctcctgtgtancctccggattcacctttagcagacagngnangagcgtcggcgcgngcgcgagggacgggcggaggtggtgtgagtagtagttagtagtagtagtacgtagtataataacaacaaacacgcgtacgtaggaacggaccgtactactactactactactagaacgaactaactaccaacgaactaactactatactactacgaacaaacgtaagtagtacgacgagagacgaccgaacgacgtacgacgtacttaataacgtacgacgacgaacggtaacgtacgttacggttacgacgtaacggtacgtaacgtacgtcgttacgtaacgttaacgtcg

SEQ ID NO: 373617 - DNA, 574 bp, Homo sapiens
  misc_feature: GZ8MTXP01EG4JA.22.82.H05.1.454.CMB.2.raw
  modified_base (306)..(306): a, c, t, g, unknown or other
  modified_base (513)..(513): a, c, t, g, unknown or other
  modified_base (570)..(570): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggccgtggtacgaggccggggggtccctgagactctcctgtgtagcctccggattcacctttagcagacatggcatgagcgtgggtcccncgaggcctccgagggggaacggggccggagtggggtgtcgagtcagttagtagtagtggtagatagtaactttaccacaaacagcgtccgtaggaaacgggcccgtacttcacctatctactaagacgacaaacttccccaaagaaccacaactgtactctagacaaagtgaactaggctagagacgccgaacgcacgacctaattntaactgcgtagaaagatagttacgggcaacgtaagggtgctacgtcgtttactaagngtcg

SEQ ID NO: 373618 - DNA, 587 bp, Homo sapiens
  misc_feature: GZ8MTXP01AILJI.22.82.H05.1.454.CMB.2.raw
  modified_base (386)..(386): a, c, t, g, unknown or other
  modified_base (413)..(413): a, c, t, g, unknown or other
  modified_base (459)..(459): a, c, t, g, unknown or other
  modified_base (487)..(487): a, c, t, g, unknown or other
  modified_base (515)..(515): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttctagtggctattttaaaacgtgtccagtgtgaggtgcagctggcggagtcgtgggggagcctggtacgaggccgggggggtccctgagtactctcctgtgtacgcctccggattcacctttagcagacatggcatgagcgtgggccccgcaggctccggagggggaacgggggccggaggtggggtgtcaggtcagttagtagtagtggtacgatagtaactttaccanaacacgtaactccgtaggaacgggccncttcacctatctctagacactaacttcccaagaaccacaactgtanctagacaaagtcgacgtagctaggacgngaccgacgacgaccggtcctaacttttntaaccgtgaccgacggaaaggatacggttacgggttcgacgtaacgggtcgcttacggtcgttataagctcg

SEQ ID NO: 373619 - DNA, 675 bp, Homo sapiens
  misc_feature: GZ8MTXP01DLAI0.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctaattttaaacgtgtccagtgtgaggtgcagctggcggagtcgtgggggagcctggtacaggccggggggtcctgagctctcctgtgtagcctccggattcaccttagcagacatggcagtgagcgtcgggtccgccgaggccgtccggaagggggaacgggggcccggtaggtgggggtgtcgaggtactaagtttaggtaagtaggtggtagaattaagtaactttaacccacaaacgaagtccgtccggtagggaaacggggccctacttaccaccatctacgtaggaacgaactaaacttaccccgaaagtaaacccactaacgttagttaactccgtaaacgaacgtaaacggtacgtaacgtacgtacgtacgacgacgaccgaaccgaccgtaccgtacgttactttacttaacgtacgacggacgaaggtaagtaacggttacgggttacggaacggtaacggtacggtaacgttacgttacgttacgtaacgttcgtcg

SEQ ID NO: 373620 - DNA, 637 bp, Homo sapiens
  misc_feature: GZ8MTXP01CU0ZJ.22.82.H05.1.454.CMB.2.raw
  modified_base (308)..(308): a, c, t, g, unknown or other
  modified_base (629)..(629): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagcctggtacgaggccggggggtccctgagactctcctgtgtagcctccggattcacctttagcagacagtggcagtgacgcgtcggggtccnccgagggccgtccggaagggggaacgggggcccggtaagggtgggggtgtacgaggtcgtaagtttaggtagttaggtggtagaattaggtaatttaacccaacaaacaacgtaaccgtcccggtagggaaacggggccctcttaccgacctatctacgtagaacgactaacttacctaagaaacctactaactgtaactcgttacgaactaaagtgaaccgttaggactagagacgccgaacgaccgacgtacctaatttataacgtgcgtagaaggtaatagttacgggcgaacgtaacggtgaactacggtctttacngttcgtcg

SEQ ID NO: 373621 - DNA, 556 bp, Homo sapiens
  misc_feature: GZ8MTXP01A6OBH.22.82.H05.1.454.CMB.2.raw
  modified_base (229)..(229): a, c, t, g, unknown or other
  modified_base (295)..(295): a, c, t, g, unknown or other
  modified_base (348)..(348): a, c, t, g, unknown or other
  modified_base (405)..(405): a, c, t, g, unknown or other
  modified_base (418)..(418): a, c, t, g, unknown or other
  modified_base (435)..(435): a, c, t, g, unknown or other
  modified_base (437)..(437): a, c, t, g, unknown or other
  modified_base (447)..(447): a, c, t, g, unknown or other
  modified_base (451)..(451): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctaattttaaaacgtgtccagtgtgaggtgcagctggcggagtcgtgggggaggcctgggtacnggccgggggggtcctggagactctcctgtgtagcctccggattcacctttagcagacatggcatgngcgtggtccgccacggcgccgaggggaagggggccggaggtgggtgtcgagtnattagtagtagtgtggatagtattacacaacagctcgtgaaggcgctcacatctcanacgacactaccanaacaacactatatctananaagtagacgngagngagacgacgacgacgacgtactacttataactcgacgacgagtacgtaacgttacggttacggacgtaacggtacggtcgtacgtacgttacgtaacgttcgtcg

SEQ ID NO: 373622 - DNA, 562 bp, Homo sapiens
  misc_feature: GZ8MTXP01EB7H0.22.82.H05.1.454.CMB.2.raw
  modified_base (391)..(391): a, c, t, g, unknown or other
  modified_base (558)..(558): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggagcctggtacaggccggggggtcctgagactctcctgtgtagcctccggattcacctttagcagacatggcatgagctgggtccgccaggctccgaggggaaggggccggagtgggtgtcgagtcattagtagagtggtgatagaatttaccacaacagctccgtagaacggggtccncgttcaccgatcctcgtaagacgacaacttcccaaagaacacactgtatctagacaaagtgacttaaggctagacgagccgaacgacacggcctagtttactaagtcgagtcgaaaggataacgttacggggttcaacgtaagggtggctacggcgtttacgtaagntccg

SEQ ID NO: 373623 - DNA, 556 bp, Homo sapiens
  misc_feature: GZ8MTXP01CYDQO.22.82.H05.1.454.CMB.2.raw
  modified_base (400)..(400): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtggggggaggcctggtacaggccgggggggtccctgagactctcctgtgtagcctccggattcacctttagcagacatggcatgagctgggtccgccaggctccgaggggaggggccggagtgggtgtcagtcattagtagtagtggtgatagatttaccactaacagctcgtgaaagggccgctcacatctntagagacaattcccaagaacacactgtatctagacaaagtcgactaggctagagagccgacgacacggacctatttataactgcgcgaaggtaatagttaaccgggttcgaacgtaaccgggtggaaccgttacggcgtttactaaggttaactcg

SEQ ID NO: 373624 - DNA, 590 bp, Homo sapiens
  misc_feature: GZ8MTXP01EYLE7.22.82.H05.1.454.CMB.2.raw
  modified_base (308)..(308): a, c, t, g, unknown or other
  modified_base (558)..(558): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggaggcctggtacgacggccgggggggtccctgagactctcctgtgtacgccgtccggattcacctttagcagacatggcatgagctgggtccncaggctccgaggggaacggggccggagtgggtgtcagtcagttagtagtagtgtagatagtaattaccacaacagctccgtaggaacggcgtacttcacatctatagagacaacttccaaagaacacatagtactctagaactaaagtcgtaacgtagacgagaacgcgacccgaacggacgacggtacctaagtttaactaacgtgcgaacgttaaaggacttaggaaccgggttcgaacgtaacgggngtaaccgtaccgtgttacggtaattaagtccg

SEQ ID NO: 373625 - DNA, 703 bp, Homo sapiens
  misc_feature: GZ8MTXP01CXL6L.22.82.H05.1.454.CMB.2.raw
tcagacatacgcgtcacgaccggtgctcgatttagtcgagctctctcgcggggtctgagagaggagcccagccctgggattttcaggttgttttcatttggtgatcaggattgaacagagagaactcaccatggagtttgggctgagctggtctttttcttgtggtcttaattttaaaacgtgtccagtgtgaggtgcagctggcggaggtcgtggggggaggcctgggtacgacgggcccgggggggtccctggacgtactctccgtgtgtacgcctccggattcacctttagcagacatggcagtgagcgtcggggtcccgccgaggccgtaccggaagggggaacgggggcccgggtaggtggggtgtcgtagtctagtttaggtagtggtggtagtatagtaatttacccacaaacagtccgtccggtaggaaacgggtccgtccttaccaccagttacctagtaagaacgtaactaaaccttaccccaaagtaaaccactaacctgttactctagtaacctaaagtacggtaactaggaccgtggaaccgacgacccggaaccgacgtacccggtactaagttttaacgtaaccgtcggttacggaacggttaaagggtaacttacgggttaaccggggttcgaaacccggtaaggggtcgtccgttaacggtcgttttacgtaacgttaagttcccg

SEQ ID NO: 373626 - DNA, 594 bp, Homo sapiens
  misc_feature: GZ8MTXP01AYWO8.22.82.H05.1.454.CMB.2.raw
  modified_base (310)..(310): a, c, t, g, unknown or other
  modified_base (347)..(347): a, c, t, g, unknown or other
  modified_base (405)..(405): a, c, t, g, unknown or other
  modified_base (424)..(424): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtcggctaattttaaaacgtgtcagtgtgaggtgcagctggcggagtcgtggggggagcctggtacgaggccgggggggtcctgagactctcctgtgtagcctccggattcacctttagcagacatggcatgagcgtgggccgcaggcnccgagggggaacgggggccggaggtgggtgtcgagtnatttaggtagtaggtggtgatagtaatttacacaacagaacgtcgtaggaagggcccncttcacactcctgacgganactaactcccaaagaacactactagtactctagacaagtacgtacgtagagagagacgaccgacgacgtacgtactacttataacgtcgacggacggaaggtaagtaaggttaacgggttacggttacgtaacggtacggtaacgtacgttcgttacgtaacgttcgtcg

SEQ ID NO: 373627 - DNA, 660 bp, Homo sapiens
  misc_feature: GZ8MTXP01BEYEQ.22.82.H05.1.454.CMB.2.raw
  modified_base (288)..(288): a, c, t, g, unknown or other
  modified_base (290)..(290): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctaggtggctaatttaaaacgtgtcagtgtgaggtgcagctggcggagtcgtgggggagccgtggtacgaggccggggggtcctgagactctctgtgtagcctcggattcacctttagcagacatggctagngngcgtcggccgcgcgcgcggagggacggggacggaggtgggtgtcgtagtacgtagttagtagtaggtggtacgtagtaagtaacttaacctaacaaacaacgtaaccgtacgtacggtaacgggaccgtacctactacctactactacgtaacgaacgaactaactaacctaacaaacaactactacgtactactacgtaactaaacgtaacgtaacgtaacgtacgtacgaacgacgaccgaaccgaaccgtaccgtaccgttaactttaacgttaacgtacgacggaacggttaacggtaacgtaacggttacgggttacggacggtaacggtacggtaaccgtacgtacgttacgtaacgttcgtcg

SEQ ID NO: 373628 - DNA, 541 bp, Homo sapiens
  misc_feature: GZ8MTXP01AGU2U.22.82.H05.1.454.CMB.2.raw
  modified_base (517)..(517): a, c, t, g, unknown or other
  modified_base (530)..(530): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctgcctttttcttgtggctattttaaaacgtgtccagtgtgaggtgcagctggcggagtcgtgggggaggcctggtacaggccggggggtccctgagactctcctgtgtagcctccggattcacctttagcagacatggcatgagctgggtccgccaggctccgaggggaaggggccggagtgggtgtcagtcattagtagtagtggtcgatagaatttaccacaacagaactccgtagaacgggccgcttcaccatctctagagacaattcccagaacacactgtatctgacaaagtgactaggctgagagaccgacgtacacggcctattataactgcgacgaaagatagacgggttcgacgaacgggngctacgccgtttntaaggaatccg

SEQ ID NO: 373629 - DNA, 655 bp, Homo sapiens
  misc_feature: GZ8MTXP01AI65C.22.82.H05.1.454.CMB.2.raw
  modified_base (325)..(325): a, c, t, g, unknown or other
  modified_base (476)..(476): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggagcctggtacgacgggccggggggtccctggacgtaccttcctccgttggtcgtacgcccgttccggtattcctaccctttagccagacagtggcatgagcgtggtccncgaggctcgaggggaacggggcggaggtgggtgtcagtcattaggtagtaggtggtagaataggtaactttaaccacgtaaacaacgtcgtccggtaggaaacggggccctcttacacctatcctataagacgaactaacttccccgaaanaacctactacgtagtactcgtagaactaaagtcgaacgtagacgtagacgacgaccgaaccgacgtacgtaccttaatttactaacgtcggacgtaacggaaacggtacgtaacggttaccgggttaccgaacggtaacggtcggtaaccgttcggttacgtttacgtaacgttcgtcg

SEQ ID NO: 373630 - DNA, 598 bp, Homo sapiens
  misc_feature: GZ8MTXP01EBX6W.22.82.H05.1.454.CMB.2.raw
  modified_base (176)..(176): a, c, t, g, unknown or other
  modified_base (276)..(276): a, c, t, g, unknown or other
  modified_base (278)..(278): a, c, t, g, unknown or other
  modified_base (280)..(282): a, c, t, g, unknown or other
  modified_base (284)..(284): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctagtggctattttaaaacgngtcagtgtgaggtgcagctggcggagtgtggggaggccgtggtacgaggccgggggtcccgtgagactctcctgtgtgctccggatcaccttagcagaanangnnngngcgtcggcgcgagcgcgagggacgggacggaggtggtgtcgtagtagtagttagtagtagtagtagtagtaagtaacgtaacaacgaaacgaacgtaacgtacgtacggacggtaccgtaccgtacgtactactactacgtagaacgaactaactaccgaacgaacaactactacgtactactacgtaactaagtacgtacgtacgacgagagacgacgaacgacgtacgtacgtacttataacgtagagagaagtagtaacgttacggttacgacgtaacggtacgtcgtacgtacgttacgtaacgttgtcg

SEQ ID NO: 373631 - DNA, 585 bp, Homo sapiens
  misc_feature: GZ8MTXP01CLUBL.22.82.H05.1.454.CMB.2.raw
  modified_base (518)..(518): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttctgtggctattttaaaacgtgtccagtgtgaggtgcagctggcggagtcgtgggggagcctggtacgaggccggggggtccctgagactctcctgtgtagcctcggattcactttagcagacatggcatgagctcgggtccgccaggctccgagggggaaggggccggagtggggtgtcagtcattaggtagtaggtggtcgatagtaactttaccacaaacagccgtccggtagaaggggccctcttccgacatctacgtagagaactaacttcccgaaagaacctacactacgtattccgtagacctaaagtcgtaacgtaggctagaagtcgaccgacgaccgtaccggctaactttntaacgtgacgtacgaaggtaatcgttacgggttcagaaccgggtgcgtacgtcgtttacgtgcgtcg

SEQ ID NO: 373632 - DNA, 679 bp, Homo sapiens
  misc_feature: GZ8MTXP01EQM3Y.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggagccgtggtaccgagggccggggggtccctgagactctcctgtgtagcctccggattcaccttagcagacatggcagtgagcgtcggggtcccgccgacggcctaccggagggggaacgggggccgggaggttgggggtgtaccgagttcgtaagtttagtaggtaggtggttagaagttaagtaaactttaccaacaacaacgtccgtccggtagggaaacggggtcccgtaccttcaaccctattcctacgtaacgaacgaacctaaacttaccccaaagaacccaacactagttactcgtagaccaaagtcgaacgtaggctaggagacggccgaaacgacgaaccggtcttaactttacgtaacgtcggttacggaacgttaaaggtagtaacggttaccggggttccgaacggtaacgggtcgtaacgtacggttcgtttacgtaaggttaactccgg

SEQ ID NO: 373633 - DNA, 661 bp, Homo sapiens
  misc_feature: GZ8MTXP01B3KF6.22.82.H05.1.454.CMB.2.raw
  modified_base (287)..(287): a, c, t, g, unknown or other
  modified_base (300)..(300): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctaatttaaacgtgtccagtgtgaggtgcagctggcggagtcgtgggggagcctggtacgaggccggggggtccctgagactctctgtgtagcctcggattcacttagcagacatggctagngagtcgtcggccncgagcgtacggaggggacgggcggtaggtggtgtacgtagtacgtagttaggtagtaggtggtacgtaagtaacgtaactaccacgaaacgtacgtccgtcggtacggaccgggtcctactacactattactacgaacgaactaacctaaccgttacccaaagtaaacctactacgtagttactacgtacgtaacgtaacggtacgtaacgtacggtacgtacggacggaccggaccggaccgaccgtaccgtaccttacgtttaacgttaacgtacgacggtacggaaggtaacgtacggttacgggttacggttacggtaacggtacggtaacgtacgtacgttacgtaacgttcgtcg

SEQ ID NO: 373634 - DNA, 634 bp, Homo sapiens
  misc_feature: GZ8MTXP01BYKWH.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggagccgtggtacgaggcccggggggtcctgacgactctccgtgtgtacgcctccggtattcacctttagcagacatggcatgagcgtcgggtccgccgaggcgtccgaagggggaacgggggccgggagtggggtgtcagtctagttagtagtaggtggtagacgttaagtaatttaccgaacaaacgacgtaaccgtacccggtagggaaacggggcccctactttaccaacctaacttccgttacgtaaaggaacgaactaaacttaccccaaagaaacctacaacttgtaactcgtagacctaaagtcgaacgtaggctaggacgacgccgacgacacggacctagtttatcgtgcgacgaggtagtacgttacgggttcaacgtaacgggtgcgttacgtccgttataaggctcg

SEQ ID NO: 373635 - DNA, 747 bp, Homo sapiens
  misc_feature: GZ8MTXP01AGTES.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagcctggtacgaggccggggggtcctgagactctcctgtgtagcctcggattcacctttagcagacatggcatgagcgtcgggtcccgccgaggccgtaccggagggggaacgggggccggtaggtcgggggtgtcgagtacgtagtttaaggtagtaggtggtacgtagtagtaactttaccacgtaaacacgtaaccgtccggtacgggaaacgggtccccgtcgtttaccaacctactcctacgtaacggacgtaaactaacctttacccgaaacgaaaccaacctaacgttacgttaactacgttacgaacctaaaggttacgaacggttacggacgttacggaacggaccggacccggaaacccggaccgtaacccgggtaccttaaacgttttaacgttaaccgtcggaaccgggaacgggttaaaggtaacggttaacggttaaccgggggttaccgaaaccgggtaacggggttcggtaaccggttacggttaccggttttacgtaacggttaacgtttcccgg

SEQ ID NO: 373636 - DNA, 550 bp, Homo sapiens
  misc_feature: GZ8MTXP01D0QVQ.22.82.H05.1.454.CMB.2.raw
  modified_base (547)..(547): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaacgtgtccagtgtgaggtgcagctggcggagtcgtgggggagcctggtacaggccggggggtcctgagactctcctgtgtagcctccggattcaccttagcagacatggcatgagcgtgggtccgccaggctccgagggggacggggccggaggtgggtgtcagtcattagtagtagtggtgatagaattaccacaacagctccgtagaacgggccgtctcacatctactagagacaacttcccaagaacacactgtatctagacaaagttcgaactaggctaggacgacgaccgaacgacacggtcctatttactaactgcgacgaaagtatagttacgggttcacgaagggtgctacgtcgtttataagntcg

SEQ ID NO: 373637 - DNA, 568 bp, Homo sapiens
  misc_feature: GZ8MTXP01AQJQ8.22.82.H05.1.454.CMB.2.raw
  modified_base (175)..(175): a, c, t, g, unknown or other
  modified_base (249)..(249): a, c, t, g, unknown or other
  modified_base (279)..(279): a, c, t, g, unknown or other
  modified_base (281)..(281): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgcgtttctaggtggctatttaaacgngtcagtgtgaggtgcagctggcggagtctgggggagcctggtacaggccggggggtcctgagctctctgtgtancctccggattcacttagcagacatggcagngngcgtcggcgcgcgcgcggagggacgggacggaggtggtgtgagtacgtagttagtagtagtggtacgtagtagtaactacacaacacgcgtacgtacggacggccgtactacactactactactagacgtactaactactaacgtaacactactacgtactactacgtactaacgtacgtacgtacgacgtagacgacgacgacgacgtacgtactacttataactcgcgacgagtacgtacgttacggcgacgtaacggtcgtcgtcgtcgttacgtcgttcgtcg

SEQ ID NO: 373638 - DNA, 641 bp, Homo sapiens
  misc_feature: GZ8MTXP01A8QP8.22.82.H05.1.454.CMB.2.raw
  modified_base (463)..(463): a, c, t, g, unknown or other
  modified_base (471)..(471): a, c, t, g, unknown or other
  modified_base (478)..(478): a, c, t, g, unknown or other
  modified_base (548)..(548): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttgtggctaattttaaaacgtgtccagtgtgaggtgcagctggcggagtcgtggggggaggcctgggtacgagggccggggggtccctgagactctcctgtgtagcctccggtattctaccttagcagacatggcagtgacgtcgtcggggtcccgccgacggccgtaccggagggggaacgggggccggaggtggggtgtcgagtcgtagttagtaggttaggtggtgatagtaactttaccacaacagtctaccggtgaaacgggccgcttcacctatctactagacgtacaacttcccgaanaaacccanaccgttntactctagacaaaggtgaacgtagggctaggaacgcgtacccggacgacgaccggaccttagtttaatcnggaccggaagttaaggaacttaggttaaccgggggttcaaaccgggaacggggttgcccgttaacgggtcgtttaccgtaaggttaacgtccg

SEQ ID NO: 373639 - DNA, 859 bp, Homo sapiens
  misc_feature: GZ8MTXP01AIHYC.22.82.H05.1.454.CMB.2.raw
  modified_base (281)..(281): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccggggggtccctggagactctcctgtgtagcctcgatctaccttacgtcanacactagtcgactagagcgtcggtccggccgacggcgtccgacggggaagggggcggggacggtgggtggtgacgtacgtagttagttagtaggtggttacggtagtagtaacgttaacctaaccaaacgaacgtaacgtacccgtacgggtaacgggacccgggtccttactaccacttacgttcgtaaacgaaacggaaacctaaacccgtttacccctaaacccgggaaacaaaacccgtcccttaaacggttttaacgtaacccgttacgtaaaactaaaaccggggttacggtaaccgggttaaccggtaacccgggtaggaacggggaaacccggaaccccgggaaacccggtttaaaccccgtaacccgggttaaacccctttaaacttttttaacggtaaacccgggtttccgggaccgggggaaaaccgggttaaaaggggttaaaccgttaaccggggttaaaccccggggggttacccgttaaaacccggggtaaacccgggggttcggtaacccgggtttaacccggtttaccggggttttaacttaacggttaaccgttcccggg

SEQ ID NO: 373640 - DNA, 626 bp, Homo sapiens
  misc_feature: GZ8MTXP01DHMO4.22.82.H05.1.454.CMB.2.raw
  modified_base (293)..(293): a, c, t, g, unknown or other
  modified_base (319)..(319): a, c, t, g, unknown or other
  modified_base (324)..(324): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctaatttaaaacgtgtccagtgtgaggtgcagctggcggagtcgtgggggagcctggtacaggccggggggtcctgagactctctgtgtagcctccggatctacttagcagacatggcatgagctggccncagctccgagggagggcgagtgggtngagtntagttagtagtgtgtacatagtactacacaacgacgtcgtcgaggaccgtcctctacactactctagacgactaactaactaccgaagaacctacgtactagtactacgtacgtaacgtaacggtaacgtaacgtacgtacgtacggaacgaacgaccggaaccgaaccgtaccgtaaccgttaactttaacgttaacgtacggttacggtaacggaaacggtaaacggtaacggttaccgggttacggttaacggtaacgggtacggtaacgttacgttacgttacgtaacgttaacgtcg

SEQ ID NO: 373641 - DNA, 608 bp, Homo sapiens
  misc_feature: GZ8MTXP01BB53W.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggcctggtacaggccggggggtccctgagactctctgtgtagcctccggattcacctttagcagacatggcatgagcgtgggtcccgcgaggcctaccggagggggaacgggggccggaggtggggtcgtcgagtcagttagtaggtagtggtagactagaactttaccactaaacagaacctccggtagaacggggcctcttcactattctactaagacgtacaacttcccaaagaaccacactgtatcagacctaaagtgaactagggctagacgacgccgaacgactaccgggtctaagtttactaacgtgcgacggaaaggtataacgttacggggttcacggtaacgggtcgtaaccttaacggtcgttttacaagttaacgttccg

SEQ ID NO: 373642 - DNA, 614 bp, Homo sapiens
  misc_feature: GZ8MTXP01C157D.22.82.H05.1.454.CMB.2.raw
  modified_base (549)..(549): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggcttattttaaaacgtgtccagtgtgaggtgcagctggcggagtcgtgggggaggcctggtacgaggccgggggtcccgtgagactctcctgtgtagcctccggattctacctttagcagacatggcatgagcgtcgggtccgccgaggcgtccgagggggaacgggggccggaggtgggtgtcgtaggtctagttagtaggtaggtggtacgtatagtaatttacccacaaacaagcgtccgtaggaaacggggcccgccgttacaccacgttcctaccgtaagacgaactaaacttccccgaaagaaccactactgtaactctagcaaaatcgaacgttaggctgacgacgccgaacgacacggacctagttttaattaaccggngacggacgaagtacgtaggttacgggttcacggtaacggtgccgtacgtcgtttcgtaagcgtcg

SEQ ID NO: 373643 - DNA, 732 bp, Homo sapiens
  misc_feature: GZ8MTXP01BL4F4.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctaggtggctaatttaaacgtgtccagtgtgaggtgcagctggcggagtcgtgggggagcctggtacaggccggggggtcctgagactctcctgtgtagcctccggtattcacctttagcagacatggcatgagcgtcgggtccgccgaggcctaccggagggggaacgggggcccgggtaaggttcgggggtgtaccgagttacgagtttaaggtaaggttaggtggttacggaacttaagtaaacttttaacccaactaaaccgaacgtaacccgtccgggtacgggaaaccggggtccctccttaccaactaacttctaccgttaagaacggtaacctaaaccgtttacccccgaaaacgtaacctaaccttacgtacgttacgtaccgtaagaacgtaacggtaacgtaacggtacggtacgtacggacggaccggaccggaaccgaccgtaccgtaccgttaacgtttaacgttaacgtacggttacggaacggttaacggtaacgtaacggttacgggttacggacggtaacggtacggtaacgtacgttacgttacgtaacgttcgtcg

SEQ ID NO: 373644 - DNA, 596 bp, Homo sapiens
  misc_feature: GZ8MTXP01COLFH.22.82.H05.1.454.CMB.2.raw
  modified_base (418)..(418): a, c, t, g, unknown or other
  modified_base (435)..(435): a, c, t, g, unknown or other
  modified_base (454)..(454): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttggctgagctggtctttttctgtggcttaattttaaaacgtgtccagtgtgaggtgcagcgtggcggagtcgtgggggagccgtggtacgaggccggggggtcctgacgactctccgtgtgtacgcctcggtatcacctttagcagacatggcatgagcgtcgggtccgccgaggcctccgaagggggacgggggcccggaggtgggtgtcgagtcattagtagtgtgtacgatagaactttacactaacacgctcgtagaagggccgtctacacatctanagagacaattacccaanaacacacgtatactcgtanactaaagtcgtaacgtaggcctaggaacgacgaccgaacgtacgaccggtacctagtttataacgtcgcgtacgaagacgtagttacggcgaacgtaacgggtcgtaacgtaccggtacgtttacctaacggttaattccgg

SEQ ID NO: 373645 - DNA, 569 bp, Homo sapiens
  misc_feature: GZ8MTXP01A5R66.22.82.H05.1.454.CMB.2.raw
  modified_base (346)..(346): a, c, t, g, unknown or other
  modified_base (401)..(401): a, c, t, g, unknown or other
  modified_base (412)..(412): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagcctggtacgagggcccggggggtcctgagactctcctgtgtacgcctccggattcacctttagcagacatggcatgagcgtgggtcccgccgaggcctccgagggggaacgggggccggaggtggggtntcgagtcagttagtagtgtgtcgatagatttaccacaacagctcgtgaacgggcncttcacatctntagagacaacttccaagaacacactgtactctagacaagtcgacgtagctagagacgccgacgacaccggacctatttacgtaactgcgacggaaggtaatacggttacgggttcgaacgaacgggtcgcctacggtcgtttacgtaagaagttccg

SEQ ID NO: 373646 - DNA, 640 bp, Homo sapiens
  misc_feature: GZ8MTXP01CBOWL.22.82.H05.1.454.CMB.2.raw
  modified_base (267)..(267): a, c, t, g, unknown or other
  modified_base (280)..(281): a, c, t, g, unknown or other
  modified_base (283)..(285): a, c, t, g, unknown or other
  modified_base (287)..(287): a, c, t, g, unknown or other
  modified_base (316)..(316): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctatttaaaacgtgtccagtgtgaggtgcagctggcggagtgtggggaggccgtggtacgaggccggggggtcccgtgagacgtctcctgtgtgcctcggntcaccttgcaganngnnngngcgcgcgcgcgcgcggagggacgggcggnggtggtgtacgtagtgtagtagtagtagtgtacgtagtagtaactactacaacacgcgtacgtacggacgggtccgtcctacactactactacgtacgaacgaactaacctaacccaaacgaaacctaacctactacgtacgtacgtacgtaacgtaaacggtaacgtaacgtacggtacgtacgaacgacgaccggaaccgaaccgtaaccgtaccgtaacttaacgttaacgtacggacggtaacggaaacggtaaacgtaacggttacggttacggacggtaacggtacggtaacgtacgtacgttacgtaacgttcgtcg

SEQ ID NO: 373647 - DNA, 567 bp, Homo sapiens
  misc_feature: GZ8MTXP01EHPTU.22.82.H05.1.454.CMB.2.raw
  modified_base (303)..(303): a, c, t, g, unknown or other
  modified_base (392)..(392): a, c, t, g, unknown or other
  modified_base (475)..(475): a, c, t, g, unknown or other
  modified_base (491)..(491): a, c, t, g, unknown or other
  modified_base (501)..(501): a, c, t, g, unknown or other
  modified_base (508)..(508): a, c, t, g, unknown or other
tcagacatacgcgtcacgaccggtgctcgatttagtcgagctctctcgcggggtctgagagaggagcccagccctgggatttttcaggtgttttcatttggtgatcaggactgaacagagagaactcaccatggagtttgggctgagctggtctttttcttgtggcttaattttaaaacgtgtccagtgtgaggtgcagctggcggagtcgtgggggagcctggtacaggccggggggtccctgagactctctgtgtagcctccggattcacctttagcagacatggcatgagcgtgggtccnccaggctccgaggggaaggggccggagtgggtgtcagtcattagagtagtgtcgatagaatttaccacaacagctccgtgaacgggccncgttcaccatctctagagaacaacttcccaagaaccacactgtaactctagaccaaaagtgaactagggcagagacgccgaanacgacggcctatttanaacttgccgngaaaggntagttaacggggttcaacgtaaacgggtgaacgttacggtcgtttctaacgttaagtcg

SEQ ID NO: 373648 - DNA, 661 bp, Homo sapiens
  misc_feature: GZ8MTXP01AFF8N.22.82.H05.1.454.CMB.2.raw
  modified_base (405)..(405): a, c, t, g, unknown or other
  modified_base (486)..(486): a, c, t, g, unknown or other
  modified_base (491)..(491): a, c, t, g, unknown or other
  modified_base (497)..(497): a, c, t, g, unknown or other
  modified_base (502)..(502): a, c, t, g, unknown or other
  modified_base (512)..(512): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttctgtggcttatttaaaacgtgtccagtgtgaggtgcagctggcggagtcgtgggggagccgtgggtacgaggtcccgggggggtccctgacgtactctccgtgtgtacgcctccggattcaccttagcagacatggctagtgaggtcgtgggtccgacccgaggccgtaccggagggggaacgggggccggtaggtggggtgtcgagtcgtagttagtagtgtggtacgtagtagtaactttacccanaaacgagtccgtccggtagggaaacgggccctacttaccaacctactctactaagggacaactaacttacccaagaaaccncactntacctnacganaagtcgacgngtacgagacgacgaccgacgacgtaccgtacttaacttcgtaacgtcggacggacggttaaacggtacggtaaccggttaccgggttacgaaccgggttaacgggtccggtaaccgttaccggttcggtttacgtaacgttccgttccg

SEQ ID NO: 373649 - DNA, 537 bp, Homo sapiens
  misc_feature: GZ8MTXP01AVSGI.22.82.H05.1.454.CMB.2.raw
  modified_base (392)..(392): a, c, t, g, unknown or other
  modified_base (402)..(402): a, c, t, g, unknown or other
  modified_base (454)..(454): a, c, t, g, unknown or other
  modified_base (464)..(464): a, c, t, g, unknown or other
  modified_base (506)..(506): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttctgtggcttattttaaaacgtgtccagtgtgaggtgcagctggcggagtcgtgggggagcctggtacaggccggggggtccctgagactctcctgtgtagcctccggattcacctttagcagacatggcatgagctgggtccgccaggctccgaggggaacggggccggagtgggtgtcagtcattagtagtagtggtcgatagaatttaccacaacagctccgtgaaggggccncttcacatcnctagagacattcccaagaacacactgtatctgacaaagtgactagactgagngccgacgacncggacctagtttataactgcgacgaaggatagttacgggttnacgaacgggtgctaagcgtttacaagaatcg

SEQ ID NO: 373650 - DNA, 568 bp, Homo sapiens
  misc_feature: GZ8MTXP01CXCTC.22.82.H05.1.454.CMB.2.raw
  modified_base (449)..(449): a, c, t, g, unknown or other
  modified_base (518)..(518): a, c, t, g, unknown or other
  modified_base (547)..(547): a, c, t, g, unknown or other
  modified_base (565)..(565): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagcgtggcggagtcgtgggggaggcctggtacgaggccggggggtccctggacgactctcctgtgtacgcctccggattcacctttagcagacatggcagtgagccgtgggtccgccgaggcctaccggagggggaacgggggccggaggtgggtgtcgagtctagttagtagtaggtggtagatagtaatttaccacaacagctcgtaggaacgggcgcttcacatctctagacgacaacttcccaagaacncgaactgatctagaacaaagtcgaacgtaggctagacgacgccgaacgacgtacggtcctatttatcgngcgacgaagatagacgggttgacgaaggngtctacgtcttactaagntcg

SEQ ID NO: 373651 - DNA, 582 bp, Homo sapiens
  misc_feature: GZ8MTXP01DTGME.22.82.H05.1.454.CMB.2.raw
  modified_base (304)..(304): a, c, t, g, unknown or other
  modified_base (408)..(408): a, c, t, g, unknown or other
  modified_base (463)..(463): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggcttaattttaaaacgtgtccagtgtgaggtgcagctggcggagtcgtgggggagccgtggtacgaggccgggggtcctgagactctcctgtgtagcctccggtattcaccttagcagacatggcatgagcgtcggtccncgaggcgtccgggggaaggggccggaggtgggtgtcgagttcagtttagtagtagtggtagatagtaactttaccactacaagacgtccggtagaacggggccncttcacctatctactagactacaacttcccaagaaacactactagtactcgtaanacaagtacggtacgtagacgagacgacgacgacgacgacgtactacttactcgtcgcgagaagacgtacgtacggttacgacgacggtcgtacgtcgtcgtacgttacgtcgttcgtcg

SEQ ID NO: 373652 - DNA, 689 bp, Homo sapiens
  misc_feature: GZ8MTXP01BJ85K.22.82.H05.1.454.CMB.2.raw
  modified_base (304)..(304): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttctgtggctattttaaaacgtgtccagtgtgaggtgcagctggcggagtcgtgggggaggccctggtacgaggcccggggggtccctgagactctcctgtgtagcctccggattcacctttagcagacatggcatgagctggggtccncaggctccggaggggaacgggggccggaggtgggtgtccgagtctagttagtagtagtggtagatagaatttaccgaacaacacgtaactcggtgggaaacgggtcccgtctttacgacctaattccgtacttaacggaacgtacctaaacgtttacccccaaagtaaacctaaccaaccttggttaaactccgttagaacctaaaggttcgaaacgttacggaccgtgaacggacggcccgaaacggaccaacccgggtccttaaattttacgttaaccttcggaccggaaccggttaaaggtacgttaacgggttaccggggttaccgaaacgtaacgggggtcgaacgttaaccggtcgttttaccgtaagttaacgttcgg

SEQ ID NO: 373653 - DNA, 607 bp, Homo sapiens
  misc_feature: GZ8MTXP01CEV90.22.82.H05.1.454.CMB.2.raw
  modified_base (310)..(310): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggagcctggtacgagggcccgggggggtccctggacgactctcctgtgtagcctccggattcacctttagctagacatggcatgagcgtgggtccncaggctccgagggggaacggggccggagtgggtgtcagtcattagtagtagtggtagatagtaatttaccacaacacgctccgtagaaacgggccgtcttacacctatctacgtaagacgactaacttccccaaagtaaccactactgtactcgtagactaaagtcgaacttagggctagaacgacgacccgaacgaccgtaccggccttaagtttacttaacgcgacgacggaaagtatcgttacggggttcaacgtaacgggtcgtccttacggtccgttttacaaggaacttcg

SEQ ID NO: 373654 - DNA, 638 bp, Homo sapiens
  misc_feature: GZ8MTXP01EV178.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggagccgtggtacgacgggccggggggtccctgagactctcctgtgtacgccgtccggtattcactttagcagacatggcagtgagcgtcgggtccgaccgaggccgtaccggagggggaacgggggccggaggtcgggtgtccgtagtcgtaagttagtaggtagtggtagaataagtaactttaaccgaactaaacgaacgtaaccgtccggtagggaaccgggccgtccttaccactacgttcctctaaggacaactaacttacccaaagaaccactactgtatccgtagactaaagtcgaacgtagtacagaacgacgaccgaaccgtacaccgtacctatttactcgtgaccgaggaaagtgtaacggttacgggcgaacgtaacgggtgtccgtacggtcgttacgtgttaacgtccg

SEQ ID NO: 373655 - DNA, 578 bp, Homo sapiens
  misc_feature: GZ8MTXP01CO0B3.22.82.H05.1.454.CMB.2.raw
  modified_base (398)..(398): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccggggggtccctgagactctcctgtgtagcctccggattcacctttagcagacatggcatgagctgggtccgccaggctccgagggggaacgggggccggaggtggggtgtcgagtctagttagtagtagtggtagatagaatttaccacaacagctcgtgaacgggccnctcacatctacagacgactaacttcccaagaaccacacttagtactctagacaaagttgaacgttaggctaggacgacggccgaacgacgtacggcctatttactaactgcggacgaaggtatacggttacgggttcacgtaacgggtcgaacgttcggtcgttacgtaagttaacgtcg

SEQ ID NO: 373656 - DNA, 575 bp, Homo sapiens
  misc_feature: GZ8MTXP01AB2YO.22.82.H05.1.454.CMB.2.raw
  modified_base (253)..(253): a, c, t, g, unknown or other
  modified_base (504)..(504): a, c, t, g, unknown or other
  modified_base (511)..(511): a, c, t, g, unknown or other
  modified_base (571)..(571): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggagcctggtacaggccggggggtccctgagactctcctgtntagcctcggatcaccttagcagacatggcagtgagctgggtccgcaggcctccgagggggaaggggccggaggtgggtgtcgagtcgagttagagtagtggtcagtagtaactttaccacaacgagctcccggtaggaacgggcccgtacttcaccatcgtctaaggacactaaattcccaagaaccacactgtaatcagacaaagtcgactaggctagagagccgaacacgtacggacctagtttattcnggaccgngaaaaggggtctaacggttacgggacacggtaacggcgtaacgtacggtcgttactaagngtcg

SEQ ID NO: 373657 - DNA, 576 bp, Homo sapiens
  misc_feature: GZ8MTXP01ELGBP.22.82.H05.1.454.CMB.2.raw
  modified_base (175)..(175): a, c, t, g, unknown or other
  modified_base (453)..(453): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctagtggctatttaaacgngtcagtgtgaggtgcagctggcggagtcgtgggggagccgtggtacaggccggggggtcctgagactctcctgtgtagcctccggatcaccttagcagacatggcatgagcgtggccgccaggcctccgaaggggaacgggccggaggtgggtgtccagtctagttagtagtacgtggtcatagaactttaccacgtaacagaactcgtagaacgggcctcttacactatctactagacgacaacttcccaagtacactactgtatcagacaaaggtnacgtgtctagagcgaccgacgcacggcttacttataacgtcgaccgtagaaaggtgtaacgttaccggggttcaacggtaacggttcgaacgttaacccggtgtttaccgtaacggttcgtcg

SEQ ID NO: 373658 - DNA, 611 bp, Homo sapiens
  misc_feature: GZ8MTXP01EAYCD.22.82.H05.1.454.CMB.2.raw
  modified_base (179)..(179): a, c, t, g, unknown or other
  modified_base (285)..(285): a, c, t, g, unknown or other
  modified_base (288)..(288): a, c, t, g, unknown or other
  modified_base (290)..(290): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctaatttaaaacgngtcagtgtgaggtgcagctggcggagtcgtgggggagccgtggtacgaggccggggggtcctgagctctcctgtgtagcctccgtattcaccttagcagacatggnagngngcgtcggtcgcgcgcgcggaggggacgggcggtaggtggtgtcgtagtagtagttagtagtaggtggtacgtatagtaactacacgaacgacgtcgtacgtacggacgtcgtctacactactactactacgacgactaactaccaacgaacactactacgtactactactaactaacgtacgtacgtacgtacgagacgacgaccgacgacgtaccgtactacttataacgtcgacggtacggaacggtaacgtacggttacggttacggttaacggtaacggtacggtaacggttacgttacgttacgtaacgttcgtcg

SEQ ID NO: 373659 - DNA, 586 bp, Homo sapiens
  misc_feature: GZ8MTXP01B666U.22.82.H05.1.454.CMB.2.raw
  modified_base (400)..(400): a, c, t, g, unknown or other
tcagacatacgcgtcacgaccggtgctcgatttagtcgagctctctcgcggggtctgagagaggagcccagccctgggattttcaggtgttttcatttggtgatcaggactgaacatagagaactcaccatggagtttgggctgagctggctttttcttgtggctattttaaaacgtgtccagtgtgaggtgcagctggcggagtcgtgggggaggcctgggtacgaggccggggggtccctggagactctcctgtgtagcctccggattcacctttagcagacatggcatgagcgtgggtccgccgaggctccgagggggaacgggggccggaggtgggtgtcaggtcagttagtagtagtggtgatagtaattaccacaacagctcgtgaacgggccncttcactatctactagagactaattcccaagaaccacactgtaactctagacaaagtgaactaggctagagacgccgacgacgtacggacctatttataactggcgtacggaaaggtacgtaaggttaccggggttacgacggtaacgggtgaaccgttacggtcgtttacgaaggttaacgttcg

SEQ ID NO: 373660 - DNA, 549 bp, Homo sapiens
  misc_feature: GZ8MTXP01CBJYN.22.82.H05.1.454.CMB.2.raw
  modified_base (302)..(302): a, c, t, g, unknown or other
  modified_base (375)..(375): a, c, t, g, unknown or other
  modified_base (395)..(395): a, c, t, g, unknown or other
  modified_base (401)..(401): a, c, t, g, unknown or other
  modified_base (405)..(405): a, c, t, g, unknown or other
  modified_base (409)..(409): a, c, t, g, unknown or other
  modified_base (543)..(543): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagcctggtacaggccggggggtccctgagactctcctgtgtagcctccggattcacctttagcagacatggcagtgagctgggtccnccgaggctccgaggggaagggggccggagtgggtgtcagtcagttagtagtagtggtagatagtaattaccanaacagctcgtgaacgggccnctcacntctntagngacaattcccaagaacacactgatctagaccaaagtgacgtaggctagagacgccgacgacacggcctattataactgcgagaaggatagttacgggttcgacgtaacggtgtaacgtacgtcgtttataacgngttccg

SEQ ID NO: 373661 - DNA, 602 bp, Homo sapiens
  misc_feature: GZ8MTXP01AMRVY.22.82.H05.1.454.CMB.2.raw
  modified_base (375)..(375): a, c, t, g, unknown or other
  modified_base (443)..(443): a, c, t, g, unknown or other
  modified_base (511)..(511): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggaggcctggtacgaggccggggggtcctgagactctcctgtgtagcctcggattcacctttagcagacatggcatgagctgggtccgccaggcctccgagggggaacggggccggagtgggtgtcagtcagttagtagtagtggtgatagaatttaccanaacagctcgaggaacggccgtcttcaccatcctctagacgacaacttccaagaacacactagtactcngacaaagtgacgtaggcgtagaacgcggaccgacgacgtaccgggtcccttaaagttttcttaaccgnggttacggacggttaaaggaactacgttaccggggttcaacgtaaccgggtggcccttaacggtcgttttaccgtaagttcgttaacccgg

SEQ ID NO: 373662 - DNA, 604 bp, Homo sapiens
  misc_feature: GZ8MTXP01DIOBY.22.82.H05.1.454.CMB.2.raw
  modified_base (297)..(297): a, c, t, g, unknown or other
  modified_base (309)..(309): a, c, t, g, unknown or other
  modified_base (346)..(346): a, c, t, g, unknown or other
  modified_base (365)..(365): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctaatttaaaacgtgtcagtgtgaggtgcagctggcggagtcgtggggggagcctgggtacaggcccgggggggtcctggacgactctcctgtgtagcctccggattcacctttagcagacatggcatggngcgtcggcgcgngcgacggagggggacgggcggtaggtggtgtagagtntagttagtagtagtggtanagtaagtacttaccacgaacagtcgtcgtacggacgggtcctactacactactctagtaagacaactaactaccgaagaaccactacgtatactactagtaactaagtacgtacgtacgtacgtagagacgacgacgaccgtacgtactacttactaacgtcgacgtacggaaggtacgtacggttacggttacggttacggtaacggtacggtcgtcgtcgttacgtaacgttcgtcg

SEQ ID NO: 373663 - DNA, 555 bp, Homo sapiens
  misc_feature: GZ8MTXP01CNNPN.22.82.H05.1.454.CMB.2.raw
  modified_base (301)..(301): a, c, t, g, unknown or other
  modified_base (364)..(364): a, c, t, g, unknown or other
  modified_base (401)..(401): a, c, t, g, unknown or other
  modified_base (416)..(416): a, c, t, g, unknown or other
  modified_base (439)..(439): a, c, t, g, unknown or other
  modified_base (454)..(454): a, c, t, g, unknown or other
  modified_base (462)..(462): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttctgtggctaattttaaaacgtgtccagtgtgaggtgcagctggcggagtcgtgggggagcctggtacgaggccggggggtccctgagactctcctgtgtagcctccggattcacctttagcagacatggcatgagctgggtccnccgaggctccgaaggggaacgggggccggaggtgggtgtcgagtcagttagtagtagtggtanactagtaattaccactaacagctcgtagaacgggccnctcacatctacaganacaacttcccaagaaccacactntaatctagacaatanagtagcgngagacgcgacgacacgacctacttataactcgacgacgaagagtagttacgggttcgacgaacggtacgcgtacgtccgttcgtaacgttgtg

SEQ ID NO: 373664 - DNA, 661 bp, Homo sapiens
  misc_feature: GZ8MTXP01EE9SS.22.82.H05.1.454.CMB.2.raw
  modified_base (484)..(484): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagcgtggcggagtcgtgggggagccgtggtacgaggcccggggggtcctgagactctcctgtgtacgcctcggtattcacctttagcagacatggcatgagcgtgggtcccgcgaggcctaccggagggggaacgggggccggaaggtcggggtgtccgagtcagtttaggtagtaggtggtcgaataagtaaatttacccaacgtaaacaacgtccttaccggtaggaaacggggccctactttaccaacctaatcctactaaggaacaactaaacttccccaaaanaaacaactactagtactctacgaactaaaggtacgtaacgtacggcaaggaacgaccgaccggaacgacgtaccgtacttaactttacgtaacgtcggacgaacgaaaggtaacgttaacggttacgggacgaacggtaagggtcgtaaccgtacggtacgtttactaagttcgtcg

SEQ ID NO: 373665 - DNA, 694 bp, Homo sapiens
  misc_feature: GZ8MTXP01AGHIZ.22.82.H05.1.454.CMB.2.raw
tcagacatacgcgtcacgaccggtgctcgatttagtcgagctctctcgcggggtctgagagaggagcccagccctgggattttcaggttgttttcatttggtgatcaggactgaacagagagaactcaccatggagtttgggctgagctggtctttttcttgtggacttaattttaaaacgtgtccagtgtgaggtgcagctggcggagtcggtgggggaggcctggtacgagggccggggggtcctgagctctctgtgtacgcctccggattctaccttagcagacatggcagtggacggcgtcggggtccccgccgacgggccgtaccggaaggggggaacgggggccgggtagggtggggtgtcgaggtctaagttagtaggtaggtggtagaatagtaacttaccacaaacacgcctccggtagggaacgggtcccgtacttaccacctactactactacgaacgaactaacttacccaacgaaaccaactactagttactactagaacaaacgtacgtaacgtacggtacgtacgcgaaaaaaaaaaaaaacgccgaaccgaccgtaccggtaccttaactttacttaacgtacgacggtaaccggaaggtaagtaacggttaccgggttaccggttaaccggtaacggtacggtaaccgttacgttccgttacgtaagttaacgtccg

SEQ ID NO: 373666 - DNA, 597 bp, Homo sapiens
  misc_feature: GZ8MTXP01EI6XO.22.82.H05.1.454.CMB.2.raw
  modified_base (529)..(529): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttatttaaaacgtgtccagtgtgaggtgcagctggcggagtcgtgggggagccgtggtacgaggccggggggtcctgagactctctgtgtagcctccggattcacctttagcagacatggcatgagcgtgggtcccgccgaggcctccgagggggagggggccggaggtgggtgtcgagtcagttagtagtagtggtacgatagtaacttaccgacaacgagtccgtccgtagggaaacgggcccgtacttacgacctacttcctacgtaaggacgtaactaacttacccaagtaaacactactgtaactctagacaaagtgacgttagctgaacgcgaccgacgactaaccggccttaatttntaactggcgacggttaagacgtagttaccgggttgacgtaacggtgccttagcgtttctaagaatccg

SEQ ID NO: 373667 - DNA, 596 bp, Homo sapiens
  misc_feature: GZ8MTXP01BJNZH.22.82.H05.1.454.CMB.2.raw
  modified_base (417)..(417): a, c, t, g, unknown or other
  modified_base (459)..(459): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtggggggaggcctgggtacgaggccgggggggtcctgagactctcctgtgtagcctccggattcacctttgcagacatggcatgagcgtgggtccgccaggcctaccggagggggaacgggggccggaggtcgggggtgtacgagtcagtttagtagtaggtggtgaacttagaatttaccgacaacagctccggtagaaacggggccncttcaaccatctactaaggacaacaacttcccaagaaaccanacctatactcttagacaatagacgtaagcgtagagagaccgacgacgacggacctacttattaactcgcgacgacggagtaagttacgggttacgacgaacggtacggtcgtacgtacgttcgtaacgttgtaaccg

SEQ ID NO: 373668 - DNA, 662 bp, Homo sapiens
  misc_feature: GZ8MTXP01B1GGV.22.82.H05.1.454.CMB.2.raw
  modified_base (589)..(589): a, c, t, g, unknown or other
tcagacatacgcgtcacgaccggtgctcgatttagtcgagctctctcgcggggtctgagagaggagcccagccctgggatttttcaggtgttttcatttggtgatcaggactgaacagagagaactcaccatggagtttgggctgagcgtggtctttttcttgtggtctaattttaaaacgtgtccagtgtgaggtgcagcgtggcggagtcgtgggggagcctggtacgagggcccggggggtcctggacgactctccgtgtgtacgcctcggtattctaccttgcagacagtggcatgacgtcgtgggtcccgccgaggcctaccggagggggaacgggggccggaggtggggtcgtacgagtcgtagttaggtagtagtggtacgtagtaagtaactttaccagtaaaccagtccgtacgtagggaacgggtcccgtacttaccgacacttcccgttagaacggaacgacctaaacttcccgaaagaacctaccctagtacgtataccgttagaacctaaagttcgacgttaaggccaaggacgaaccgcgaaccgacgtaccggtaccttaacgtttataaccgnggaccggtagaaagtacgtagttacgggttcaaacggtaaggtcgtcgtacggtcgtttacaacgttcgtccg

SEQ ID NO: 373669 - DNA, 605 bp, Homo sapiens
  misc_feature: GZ8MTXP01DS6X7.22.82.H05.1.454.CMB.2.raw
  modified_base (298)..(298): a, c, t, g, unknown or other
  modified_base (567)..(567): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggcttatttaaaacgtgtccagtgtgaggtgcagctggcggagtcgtggggagccgtggtacaggccggggggtcctgagctctcctgtgtagcctccggattcacctttagcagacatggcatgagctcgggtccnccgaggctcgaggggaacgggggccggagtgggtgtcgagtcattagtagtagtgtacgatagtaatttaccactaacagcgtccgtaggaaacgggcccgtacttaccgactactaccgtactaaggacgaacctaaacgttaccccaaagaaacctacaaccttgtaaactctagaacctaaaggtcgaacgttagggacctaggaacgacggaccgaacgacgtacgactatttaataacgtgacgacgaagtactagacgggttnaacgtaacggtagcgtacgtcgttacgaagttaactcg

SEQ ID NO: 373670 - DNA, 716 bp, Homo sapiens
  misc_feature: GZ8MTXP01DP0MJ.22.82.H05.1.454.CMB.2.raw
  modified_base (321)..(321): a, c, t, g, unknown or other
tcagacatacgcgtcacgaccggtgctcgatttagtcgagctctctcgcggggtctgagagaggagcccagccctgggatttttcaggtgtttttcatttggtgatcaggactgaacagagagaactcaccatggagtttgggctgagctggtctttttcttgtggcttaattttaaaacgtgtccagtgtgaggtgcagctggcggagtcgtgggggagccgtggtacgacgggccgggggtcctgacgactctccgtgtcgtacgccgtccggtacttcctaccttagcagacagtggctagtgagtccgtcgggtccnccgacggccgtaccggaagggggaacgggggccggtaggtcgggtcgtacgaggtctaagttaggtaggtaggtggtacgattaagtaacttaccaactaaacgaacgtccgtccggtagggaaaccgggtccctaccttaccgaacctactccttacgtaacgaacgtaaacctaaccttacccgaaagaacctaaccgtacttagtactcgtacgaacctaaaggtcgtaacgtacgcgtagacgacgaccgaacgacgtacggtaccttaatttacgtaacgtcgacggtaacggaaacgtaacgtaacgggttaccggggttaccgaaaccgggtaacgggggttcgtaacccggtttaacggttacccgttacgtaagttaacgttcccg

SEQ ID NO: 373671 - DNA, 741 bp, Homo sapiens
  misc_feature: GZ8MTXP01BQBUY.22.82.H05.1.454.CMB.2.raw
  modified_base (302)..(302): a, c, t, g, unknown or other
tcagacatacgcgtcacgaccggtgctcgatttagtcgagctctctcgcgggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggagcctggtacaggccggggggtccctgagactctcctgtgtagcctccggattctaccttagcagacatggcatgagcgtgggtccnccgaggctccgaggggacggggccggagtgggtgtcagtcattagtagtaggtggtcgatagtaatttaccgacaacagaactccggtaggaaacggggccctcttaccaccgtaactcctacgtaagaacggtaccaaactttaccccgaaagaaacctaacctaccgttagtaacttaccgtacgtaacctaaaacggttaggtacccgttaaagggcccttagggaaacggaccggacccggaaacccgggaaaccgtaacccggggacccctttaaaggtttttaacttaaaccggtacggttacccggaaaccgggttaaaggttaacgttaaacggttacccgggggttaccgaaaccgggtaaaccgggggttcgggtaacccgtttaaacccgggtccggttttttacccggaaggttaacgtttccccgg

SEQ ID NO: 373672 - DNA, 633 bp, Homo sapiens
  misc_feature: GZ8MTXP01CUBO6.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcacatggagtttgggctgagcgtggtcttttctgtggcttaattttaaaacgtgtccagtgtgaggtgcagcgtggcggagtcgtgggggagccgtgggtacgagggccggggggtcctgacgactctcctgtgtacgcctcggtattctaccttagcagacatggcatgagcgtcgggtccgccgaggccgtacggagggggacgggggccggaggtgggtgtacgagtctagttagtagtagtggtagaacttagtaacttaccgaactaaacaacgtcgtccgtaggaacggggccctactacacctatctacgtaaggaacaactaaccttaacccaagaaaccactacttacaattcaagactaaaaggttcgaacggttagaccgtagaacgacgcccggtaaaccgcgaaccggtaccttaattttacgaacgtcgacgacgagtaacgtaagttaccgggttcaaacgggtaacgcggtctacgtcgttacaagcttccg

SEQ ID NO: 373673 - DNA, 686 bp, Homo sapiens
  misc_feature: GZ8MTXP01BSF0W.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggctaattttaaaacgtgtccagtgtgaggtgcagctggcgagtcgtgggggagcctggtacaggccggggggtcctgagactctcctgtgtacgcctccggattctacctttagcagacagtggcagtgagcgtcgggtcccgccgaggcctccggaagggggtaacgggggccgggtaggtggggtcgtcgagttactagtttagtaggtggtggtagaattaagtaactttaacccaacaaccgtaagtccgtaccggtaggaaacgggtccctaccgttaccaacccgtattcccgtaacgtaggaacggtaaacctaaacgttaccccaaaacgtaaccctactaccgttagttaactccttagaaacctaaaggtgtaacgtaacgggcttaggaacggaccgtaccggaccgaacctcgggtaaccttagtttaaacgtccgtagacccggtagaaggtaactagggttaccggcgacgaacccgggtgaacgttacggtcgttacgtaagcgtcg

SEQ ID NO: 373674 - DNA, 633 bp, Homo sapiens
  misc_feature: GZ8MTXP01D2L0U.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctatttaaaacgtgtccagtgtgaggtgcagctggcggagtcgtgggggaggcctggtacaggccggggggtccctgagactctcctgtgtagcctccggattcaccttagcagacatggcatgagctgggtccgccaggctccgaggggaaggggccggaggtgggtgtcgagtcattagtagtagtggtgatagaatttaccacaacagaactcgtagaaacgggccgacttcacctatccgtctaaggacgactaacttaccccaagtaaaccacctacgtagttaactcctagtaccaaagttgaaccgttaaggccgtagaacgacgacccggtaaacgaccgaaccgggtaccctaagtttactaaccgtggaccgtaccggaaaggtaagttaacgttaaccggggttcgaaaccgtaacgggtcgggtccttaacggtcggtttaccttaaggaactttcgg

SEQ ID NO: 373675 - DNA, 611 bp, Homo sapiens
  misc_feature: GZ8MTXP01DULK0.22.82.H05.1.454.CMB.2.raw
  modified_base (302)..(302): a, c, t, g, unknown or other
  modified_base (390)..(390): a, c, t, g, unknown or other
  modified_base (432)..(432): a, c, t, g, unknown or other
  modified_base (436)..(436): a, c, t, g, unknown or other
  modified_base (458)..(458): a, c, t, g, unknown or other
  modified_base (466)..(466): a, c, t, g, unknown or other
tcagacatacgcgtcacgaccggtgctcgatttagtcgagctctctcgcggggtctgagagaggagcccagccctgggatttttcaggtgttttcatttggtgatcaggactgaacagagagaactcaccatggagtttggctgagcgtgtcgttttctagtggctaatttaaaacgtgtccagtgtgaggtgcagctggcggagtcgtgggggagccgtggtacgaggccgggggtcctgagctctcctgtgtagcctccgtattctaccttagcagacagtggcagtgagtcgtcggccnccaggccgtccgagggggacggggccggtaggtgggtgtcgaagtctagtttaggtagtaggtggtacgataagtaactttacccaanaaacgagaacgtccgtagaactcgcctctacacctatcctanaganaccaaacttcccagacacagtntatcgaanagaatgacgtagcagacgaccgtaccgacgtaccgtacgtacttagtttaacgtcgacgtacggttaacggtaaagtcgttaccgggttacgggacgtaacgggtacggttcggtaccgttacggttcgttaacgttaagtaacg

SEQ ID NO: 373676 - DNA, 645 bp, Homo sapiens
  misc_feature: GZ8MTXP01DY8CO.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggccgtggtacgaggccggggggtccctgagactctccgtgtgtacgccgtccggattcacctttagctagacatggcagtgagcgtggtccgcaggcgtcgaggggacgggggccggaggtgggtgtcgagtcgtagtttagtagtaggtggtacgataagtaagtttaccaacaacagtcctcgtagaacgggcctacttacgacctatctactagacgaactaacttacccaaagaaacaccgaacttagtactactagaaccaaagtacgaacgtaggactaggaacgaccggtaccgaaccgaccgtaccggtacctttaaagtttacgtaacgttcggacggaaccggttaaaggtaagtacggttaaccggggcaaacggtaacggtcgggaactacggtcgtttacgaacgttaagttccg

SEQ ID NO: 373677 - DNA, 792 bp, Homo sapiens
  misc_feature: GZ8MTXP01BJDJS.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaacgtgtccagtgtgaggtgcagctggcggaggtcgtgggggagcctgagtacgacgggcccggggggtccctggacgtactctccgtggtgtacgcccttccggattcctactttagcagacagtggacagtggagccggtcggggtcccgaccgacgggccgtaccggaggggggaacgggggccggtagggtggggtcgtcgagtcgtaagtttaggtaggttaggtggtacgtaagttaacgtaaactttacccaaacgtaaccgaaggtaccgttacccgggtacgggtaaccgggggtcccttacctttaccgaacccttacttacccgttaccgtaaaggaaccgtaaaccttaaacctttaacccccgaaaggtaaaacccctacctaccgttagtaacttccgtaacggtaacctaaaagttacggtaacgtaacgggtacctaaggaaccggaccggaaccccggaaccgaacccgtaaccggtaccctttaagttttaacgttaccgacggggaccgttaaacggtaaaggtacgttaacgggttccggggaccgtaaccggtaaacggggtcggtacctaccggttacgtttaacgttaacggtcg

SEQ ID NO: 373678 - DNA, 563 bp, Homo sapiens
  misc_feature: GZ8MTXP01DG59T.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacaggccgggggggtccctgagactctcctgtgtagcctccggattcacctttagcagacatggcatgagctggtccgcaggctccgaggggaaggggccggagtgggtgtcagtcattagtagtgtggtgatagatttaccacaacagctccgtgaaacgggccgcttcaccatctctagagacaacttcccaagaacacactgaactctagacaaatcgacttaaggctagacgacgaccgaacgactaaccggtccaatttacttaactcggacgacggaaaggattagttacgggttcgaacgtaacgggtgcgttacgcgtttactaagttgttccg

SEQ ID NO: 373679 - DNA, 624 bp, Homo sapiens
  misc_feature: GZ8MTXP01CLEVL.22.82.H05.1.454.CMB.2.raw
tcagacatacgcgtcacgaccggtgctcgatttagtcgagctctctcgcggggtctgagagaggagcccagccctgggatttttcaggtgtttttcatttggtgatcaggattgaacagagagaactcaccatggagtttgggctgagctggtctttttcttgtggcttaattttaaaacgtgtccagtgtgaggtgcagcgtggcggagtcgtgggggagcctggtacgagggccggggggtccctgacgactctcctgtgtacgcctccggattcacctttagcagacatggcagtgacgtcgtcgggtcccgccgaggccgtaccggaagggggaacgggggcccggtagggttcggggtagtcgaggtcctagtttagtaggttaggtggtagaatagtaactttaccaacaacgagcctccggtaggaacgggccgacttacgaccatctacgtagacgaactaacttacccaagaaccacgactgatacagactaaagtgaacgtaggctagacgcgaccgacgaacgtaccggtacctatttataactggcgtacgaggaatcggttacgggcacggtaacggtcggaacttacggtcgttactaagttcgtaaccg

SEQ ID NO: 373680 - DNA, 916 bp, Homo sapiens
  misc_feature: GZ8MTXP01DG49Z.22.82.H05.1.454.CMB.2.raw
  modified_base (293)..(293): a, c, t, g, unknown or other
  modified_base (312)..(312): a, c, t, g, unknown or other
tcagacatacgcgtcacgaccggtgctcgatttagtcgagctctctcgcggggtctgagagaggagcccagccctgggatttttcaggttgtttttcatttggtgatcaggactgaacagagagaactcaccatggagtttggctgagctggtctttttcttgtggtcttaattttaaaacgtgtccagtgtgaggtgcagcgtggcggagtcggtgggggagccgtggtacgagggcccgggggtcctgagtactctcctgtgtacgcctcggattcctacttagcagacanggcagtgagcgtcggtccnccgagccgtcggaagggggaacgggggcggtaggtgggtcgtacgagtacgtagttaggtaagttacggtagggttacgaaagttaacgtaaactttacccaaacgtaaaccgtaaggtaacccgttaccgggtaaacgggtaaacccgggggtcccctacccgtttaacccaaaccggtacttacccgttaaacgttaaacgtaaaccggtaaaccttaaaaccccgtttaaccccgaaaacgtaaaaccccgtaaccttaaccgtttacggttaaacttaccgggtaaactaaaacccgttaaaaaggttacggtaaaccggtttaaagggaccccgttaagaacccgggaacccggttaaccccggaaaaccgtaaccccggtaaacccgggttaacctttaaacgttttttaaacccggtaaaccgttacgggttaacccccgggaaaacgggttaaaagggtaaacccggttaaaacggggttttaaaccccgggggcccggttaaaaaacccggggttaaccgggggtttaaccggtaaccggtttaacccgggttttaccggttttaaccggtaaacggtttccgggtttaaccccg

SEQ ID NO: 373681 - DNA, 599 bp, Homo sapiens
  misc_feature: GZ8MTXP01ATQQA.22.82.H05.1.454.CMB.2.raw
  modified_base (306)..(306): a, c, t, g, unknown or other
  modified_base (475)..(475): a, c, t, g, unknown or other
  modified_base (526)..(526): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttctgtggctattttaaacgtgtccagtgtgaggtgcagcgtggcggagtcgtgggggagcctggtacaggccggggggtccctgacgtactctccgtgtgtagcctcggattcaccgttagcagacagtggcatgagtcgtcgggtccnccgaggctacggagggggacggggccggaggtgggtgtcgagtcagttacgagtagtgtagatagtaacttaccacaacgagcgtcggtaggaacgggtccctacttaccactactcgtacgtaggaacactaaccgttcccaaagtaaccatacgtagttactcgtanactaaaggtcagttagcctgaacgcgcggaaccagtaccgtactacgtttnaactgacgacgaagtagttacggacggttcgacgtaaggtcggaacttcggctttacgaacgttaacggtccg

SEQ ID NO: 373682 - DNA, 563 bp, Homo sapiens
  misc_feature: GZ8MTXP01DKERZ.22.82.H05.1.454.CMB.2.raw
  modified_base (292)..(292): a, c, t, g, unknown or other
  modified_base (367)..(367): a, c, t, g, unknown or other
  modified_base (381)..(381): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttctgtggctattttaaaacgtgtccagtgtgaggtgcagctggcggagtctgggggagcctggtacagccggggggtcctgagactctcctgtgtagcctcggattcaccttagcagacatggcatgagctggtccncaggctccgagggaacggggccggagtgggtgtcagtcattagtagtgtcggtgatagatttaccacgtacagcncgtagaagggccgnttcacctagtctctagagacaattcccaagaacacactgtaatctagacaaaggtgacgtaagctagagacgaccgaacgaccgaacgggccctaagtttactaactcggacggaccgaaaggtataagttaccgggttcgaaccgtaacgggtgcgtacgtcggtttaccaagttcttcgg

SEQ ID NO: 373683 - DNA, 670 bp, Homo sapiens
  misc_feature: GZ8MTXP01ADLVK.22.82.H05.1.454.CMB.2.raw
  modified_base (316)..(316): a, c, t, g, unknown or other
  modified_base (656)..(656): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaatttaaaacgtgtccagtgtgaggtgcagctggcggagtcggtgggggagccgtgggtacgacgggtccggggggtcctgagacctctctgtcgtacgtccgtcggtacttcacctttagcagacagtggcatgagtcgtcgggtccncgaggccgtaccggagggggaacggggtccggaggtgggtcgtacgagtcgtagttagtagtaggtgtagatagtaacttaccataacgacgtcgtcgagggaacggtccgtcttacactactctataacgacgtaacctaacttaccccaaagtaacctactacttacggtaacttacctacgtaacaaacggttacgaaccgttacggacgtaggaacgaccggacccgaaccggaaccgtaccggtaccttaagtttaaccgttaacgaacggcgtaaacggaggtaacgttaaggttaccgggttcgacgtaacgggtgtaacgtcggtcgtttanaacgttaacgtccg

SEQ ID NO: 373684 - DNA, 637 bp, Homo sapiens
  misc_feature: GZ8MTXP01EGRTP.22.82.H05.1.454.CMB.2.raw
  modified_base (300)..(300): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagccgtggtacgaggccgggggtcctgagactctctgtgtagcctcggattcacctttagcagacatggcatgagctcgggtccnccgaggctccgagggggagggccggagtgggtgtcaggtctattagtagtagtggtagatagtaatttaccactaaacacgctccggtagaacgggcccgtacttacgacctaattctactaagacgaacctaacttaccccgaaagaacctaacacgttataactcttagaacctaaagtcgaacgtagctagagacgccggaacgaccgtaccggtacctagtttaactaacgtcgcggacggaaaggtagttaacgttaccggggttacgaaaccgtaaacggggttcggtaaccgttaaccgggtcgttttaccgaaggttcgtttaacccgg

SEQ ID NO: 373685 - DNA, 718 bp, Homo sapiens
  misc_feature: GZ8MTXP01ASXFN.22.82.H05.1.454.CMB.2.raw
  modified_base (303)..(303): a, c, t, g, unknown or other
  modified_base (353)..(353): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcttggtctttttcttgtggtcttaattttaaaacgtgtccagtgtgaggtgcagcgtggcggagtcgtgggggagccgtggtacgacgggccgggggtcctgacgtactctccgtgtgtacgcctccggtattctaccttagcagacagtggctagngacgcgtggcccgacgaggccgtcggaggggaacggggcggaggtgggtntcgagtctagttagtagttaggtggttagaaagttaacgtaactttaccgaacaaacgacgtaaccgtccgggtaacgaacgggtccctacttaccacctattccgtacttaaggacgtaaacctaaccgttacccaaacggaaaccacgtaccttagtaccttaacgtacgaaacgttaaacggtacggtaaccggtagccgttaaggaaccggtaccgacccggtaaaccgaccgtcccgggttaacttaacgtttcgtaaccgttgggaccgtaaacgttaaaggtacgttaacgggttaccgggttacttaaccgggtaacggtcgtaaccgttaccggtcttacgtaaggttctaaccgg

SEQ ID NO: 373686 - DNA, 569 bp, Homo sapiens
  misc_feature: GZ8MTXP01AV7RM.22.82.H05.1.454.CMB.2.raw
  modified_base (381)..(381): a, c, t, g, unknown or other
  modified_base (406)..(406): a, c, t, g, unknown or other
  modified_base (425)..(425): a, c, t, g, unknown or other
  modified_base (510)..(510): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctgggtacgaggccgggggggtccctgagactctcctggtgtacgcctccggattcaccctttagcagacatggcatgagcgtggggtccgccgaggctaccgaggggaagggggccggagtgggtgtcagtcagttagtagtagtggtcgatagaatttaccanaacacgctccggtgaaacggggccncgttcaccatctctagganacacttcccgaagaacacacctgtattacagacaaagtcgactagactgacgaggaccgacgacacggcctaatttacttaacgngcgacgaagtatacggttacggcgacgtaaggtgcctacgtcgttacgtaagttcgtcg

SEQ ID NO: 373687 - DNA, 746 bp, Homo sapiens
  misc_feature: GZ8MTXP01B70M7.22.82.H05.1.454.CMB.2.raw
tcagacatacgcgtcacgaccggtgctcgatttagtcgagctctctcgcggggtctgagagaggagcccagccctgggattttcaggttgttttcatttggtgatcaggactgaacagagagaactcaccatggagtttgggctgagctggtctttttcttgtggcttaattttaaacgtgtccagtgtgaggtgcagcgtggcggagtcgtgggggagcgtggtacgacgggccggggggtcctgacgtactctcgtgtcgtacgcctccggtattctaccttagctagacatggcatgagcgtgggtccgccgaggctcggagggggacgggggccggaggtgggtgtcgagtcgtaagttagtagtagtggtacgtatagtaaactttaccaacaacgacgtccgtaccggtaggaacgggtccgtacttaccactacgtctacgtaagacgtaactaaacttcccgaaacgtaaccacgaacttacggtaacttccgtaacgtaaccctaaaagggttacggtaaaccggttacgggtaccgtacggaaacggacccggaacccgggaaacccggtaacccgtaaccccggggtaactttaaacgttttaaccgttaaccggtaacggttacccgggtaaacgggaaaaccggttaagtaacgggttaacccgggggttcgaaaaacccgggtcgggtaccggtaacgttaacggttccgtttacgtaagttcgtttaaccg

SEQ ID NO: 373688 - DNA, 643 bp, Homo sapiens
  misc_feature: GZ8MTXP01APRS0.22.82.H05.1.454.CMB.2.raw
  modified_base (326)..(326): a, c, t, g, unknown or other
  modified_base (474)..(474): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggacgccgtggtacgaggccgggggtcctgagactctcctgtgtacgcctcggattcacttagcagacatggcatgagcgtcggtccgcgaggccgacgagggggagggccggngtgggtgtcagtctagttagtagtagtggtagatagtaattaccacaaacacgtcctcggaggaacgggccctaccgttcacctactctacgtaagacgaacctaaccttacccgaacgaaacctacacgttagtacttcgtacgaanaaaggtacgaacgtacggcgtaggacgaccgaccggaaccgacgtaaccgtcttaacgtttctaacgtcggaccgtacggaaagggtacgtaacggttaacggggttccgaaacggtaacgggtcggtaacccgttacggtccggttttactaaggttcgtttaaccgg

SEQ ID NO: 373689 - DNA, 629 bp, Homo sapiens
  misc_feature: GZ8MTXP01DN6EE.22.82.H05.1.454.CMB.2.raw
  modified_base (300)..(300): a, c, t, g, unknown or other
  modified_base (477)..(477): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagcctggtacgaggccggggggtcctgagactctcctgtgtagcctcggattcaccttagcagacatggcatgagcgtgggtccnccgaggcctccggagggggaacgggggccggaggtgggtgtcgagtcagtttaggtagtaggtggtacgataagtaactttaccaactaacacgtaaccgtccgtaggaaacgggtcccgtcttacgacctatcctacgtaagacgactaaacttaccccaagaaacctactacgtntaactccgtagaacctaaagtcgaacgttaggctagaacgacgaccgtaacgactaccggtacctaagttttctaacgtgacgaacggaagtagtacggttacgggttcaacgtaacgggtgccgttaacggtcgtttacaaggttaactcg

SEQ ID NO: 373690 - DNA, 596 bp, Homo sapiens
  misc_feature: GZ8MTXP01DKZ47.22.82.H05.1.454.CMB.2.raw
  modified_base (315)..(315): a, c, t, g, unknown or other
  modified_base (415)..(415): a, c, t, g, unknown or other
  modified_base (467)..(467): a, c, t, g, unknown or other
  modified_base (526)..(526): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagcgtggcggagtcgtgggggaggccgtggtacgacgggcccgggggggtccctggacgtactctcctggtgtacgcctcggattcacctttagcagacatggcatgagcgtgggtccnccgaggcctccgagggggagggggccggaggtcgggtgtcagtctagttagtagtagtggtagaatagtaaacttaccacaacagctcgtagaagggccncttcaccatcctataagacactaacttacccaagaaacacactgtatcgtanacaaaggtcgaacgtaggactgaagcgaccgtaacgactacggcctaattcttaaccgngacgagaagtagtacggttacggttacgacggtaacggtacgtccgtacggtcttacgtaagttcgtccg

SEQ ID NO: 373691 - DNA, 613 bp, Homo sapiens
  misc_feature: GZ8MTXP01BABKA.22.82.H05.1.454.CMB.2.raw
  modified_base (196)..(196): a, c, t, g, unknown or other
  modified_base (460)..(460): a, c, t, g, unknown or other
  modified_base (528)..(528): a, c, t, g, unknown or other
  modified_base (592)..(592): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggtcttaattttaaaacgtgtccagtgtgaggtncagctggcggagtcgtgggggagccgtggtacgacgggcccggggggtcctggagactctccgtgtgtacgcctccggtattctaccttagcagacatggcagtgacgctgggtcccgcgaggctaccggaggggtaacggggccggaggtcgggtgccgtaggtacagtttaagagttaggtggtcgagtacgtaaactttaccaacgaacacgtaaccttccggtagggaaacggtcccgtacttacaaccctatcccttanaaggtaacaactaaacttcccaaacgtaacactaacctagtatcagtaccaaatgatagactgaacgngcctaccgaactcggacctattaatctgcgacggttaaagatacgacgggttcaacgtaacggngctacgcggtttcaagttgtc

SEQ ID NO: 373692 - DNA, 590 bp, Homo sapiens
  misc_feature: GZ8MTXP01EG0WP.22.82.H05.1.454.CMB.2.raw
  modified_base (290)..(290): a, c, t, g, unknown or other
  modified_base (296)..(296): a, c, t, g, unknown or other
  modified_base (344)..(344): a, c, t, g, unknown or other
  modified_base (436)..(436): a, c, t, g, unknown or other
  modified_base (443)..(443): a, c, t, g, unknown or other
  modified_base (461)..(461): a, c, t, g, unknown or other
  modified_base (469)..(473): a, c, t, g, unknown or other
  modified_base (479)..(479): a, c, t, g, unknown or other
  modified_base (481)..(481): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctggggggagcctggtacaggccgggggggtcctgagactctcctgtgtagcctccggattcacctttagcaagctaggtcgacntagacngtcgggtcccacgaggcctccgaagggggacgggggccgaggtgggtncgagtctattaggtagtagggtggtacgtaagaaagtttaaacttaccacaaacgaagtcccgtcgtaagggaacggggcctcttaccaacnttcctanagacactacctaccgaanaaccaacnnnnntctcananagagacgcgtgagacgacgaacgacgacgacgttacgtacttacttacgttcgacggaacggtaacgtaacggtaacggtacggttacggtaacggttaacggtaacgg

SEQ ID NO: 373693 - DNA, 718 bp, Homo sapiens
  misc_feature: GZ8MTXP01DQ9GG.22.82.H05.1.454.CMB.2.raw
  modified_base (257)..(257): a, c, t, g, unknown or other
  modified_base (381)..(381): a, c, t, g, unknown or other
  modified_base (436)..(436): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttggctgagctggtcttttcttgtggcttattttaaaacgtgtccagtgtgaggtgcagctggcggagtcgtgggggagccgtggtacgaggccgggggtccctgagactctcctgtgtancctccggtatcctaccttagcagacagtggctagtgacgcgtcgggtaccgccaacggctaccgaagggggaacgggggccggtaggtggggtgtccgagtctagtttaggtaagtggtggtanactaagtaactttaccaacaacagtccgtccgtaggaaacgggcccgtcttaacncccgtaattcctacgtacggaactaactaaaccttccccaaaagaacaactaccgtagttaatcccttagaacctaaaaggttcgaaaccggttgcccgttaaggacgaaccggcccggaaaacggtactaaccccgggtaaccgttaattttagtttaaaccgcggaacgggtaacccgttaaaggggtaaacttacgggtttaacccgggggacttaaaccgggaacgggttcggggtaacctttaccggtaccgggtttttactaacggttaacgtccg

SEQ ID NO: 373694 - DNA, 642 bp, Homo sapiens
  misc_feature: GZ8MTXP01CVAZ5.22.82.H05.1.454.CMB.2.raw
  modified_base (316)..(316): a, c, t, g, unknown or other
  modified_base (435)..(435): a, c, t, g, unknown or other
  modified_base (633)..(633): a, c, t, g, unknown or other
tcagacatacgcgtcacgaccggtgctcgatttagtcgagctctctcgcggggtctgagagaggagccccagccctgggattttcaggtgttttcatttggtgatcaggactgaacagagagaactcaccatggagtttgggctgagctggtctttttctgtggctattttaaaacgtgtccagtgtgaggtgcagctggcggagtcgtgggggagcctgggtacagggtcccggggggtcctggacgtactctctgtgtacgccgtccggtattccacctttagctaagacagtggacagtgagcgtcgggtccnccgaggctaccggagggggacggggccggtaggtgggctcgagtcgtattagtaagtgtaggtagagtagtaacgttacactaacaacgcgtcgaggaacgggcctccgtacaaacctntctacgtagaacgactaaaccttacccgaaagtaaccaactaccttaaggttactacgtacgaactaaagtacgtacgttagacgtagacgacgccgaacgacctaccggacttacttcgtaacgtcgacggtaaacggagtaacgtacgacgggttccgaacgtcgggtacgaacttacggtcccgtttagtaacgngttaacccg

SEQ ID NO: 373695 - DNA, 541 bp, Homo sapiens
  misc_feature: GZ8MTXP02IFYB4.22.82.H05.1.454.CMB.2.raw
  modified_base (369)..(369): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccggggggtccctgagactctcctgtgtagcctccggattcacctttagcagacatggcatgagctgggtccgccaggctccgaggggaaggggccggaggtgggtgtcagtcattagagtagtggtgatagaattacanacagactccgtagaaacgggccgcttcaccatctctagagacaattcccaagaacacaactgtatctagcaaaatgactaggctgagacgaccgacgacacggcctaatttatactgcgacgaaaggatacgtacggggtacacgaaacggtgactacgcgtttcagtatcg

SEQ ID NO: 373696 - DNA, 593 bp, Homo sapiens
  misc_feature: GZ8MTXP02HWLVK.22.82.H05.1.454.CMB.2.raw
  modified_base (399)..(399): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgcgttttctagtggctatttaaacgtgtcagtgtgaggtgcagctggcggagtctgggggaggcctggtacagccgggggggtcctgagactctcctgtgtagcctccggattcacctttagcagacatggcatgagctgggccgccaggctccaggggaaggggccggagtggggtgtcagtcatagtagtagtggtgatagatttacacacagactcgtagaaggccgcttcaccatcctactagaanacaactaccacaacacactatatactagtactaaatagtaacgtaggtacgtagagacgaccggaaccgaaccgaaccggtaccgtaactttaactttaacttacggtacggacggaaaggtaaacgtaacgtaacgggtaaccggaacgtaacggtacggtacgtacgtaccggtttacgttacgtacgtacg

SEQ ID NO: 373697 - DNA, 550 bp, Homo sapiens
  misc_feature: GZ8MTXP02G56C9.22.82.H05.1.454.CMB.2.raw
  modified_base (151)..(151): a, c, t, g, unknown or other
  modified_base (175)..(175): a, c, t, g, unknown or other
  modified_base (272)..(272): a, c, t, g, unknown or other
  modified_base (274)..(274): a, c, t, g, unknown or other
  modified_base (276)..(276): a, c, t, g, unknown or other
  modified_base (308)..(308): a, c, t, g, unknown or other
  modified_base (425)..(425): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgngtttctagtggctatttaaaacgngtcagtgtgaggtgcagctggcggagtctgggggagcctggtacagccggggggtcctgagctctctgtgtagcctcggattcaccttagcagacangnangagcgtcggtcgcgacgcgcgaggagggcggnggtggtgtgagtcgtagtagtagtagtgtagtagtagtattacacacacgcgtacgtacgacggacgtctcacactactactagacgacaactaccacaacacactacgtatactanacaatacgtacgtagtacgagagacgacgacgacgacgacgtacttacttacgtacgacgacgaaggaacgtacgtacggtacggacgaacggtacggtacgtacgtacgttacgtacgtagtcg

SEQ ID NO: 373698 - DNA, 552 bp, Homo sapiens
  misc_feature: GZ8MTXP02H5XYX.22.82.H05.1.454.CMB.2.raw
  modified_base (373)..(373): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctagtggctattttaaacgtgtcagtgtgaggtgcagctggcggagtctgggggaggcctggtacgaggccgggggggtccctgagactctcctgtgtagcctccggattcacctttagcagacatggcatgagctgggtccgccaggcctccgaggggaaggggccggagtggggtgtcagtcattagtagtaggtggtgatagaatttaccaanacagctcgtaggacggcctctacacatctacagacactactacccaagaaccacactgtactctagacaatagagtagagagagacgacgacgacgacgactacttatactacgacgacgagacgtacgtacggtacgacgaacggtacggtacgtacgtacgttacgtacgtacgtcg

SEQ ID NO: 373699 - DNA, 554 bp, Homo sapiens
  misc_feature: GZ8MTXP02G0AR0.22.82.H05.1.454.CMB.2.raw
  modified_base (151)..(151): a, c, t, g, unknown or other
  modified_base (367)..(367): a, c, t, g, unknown or other
  modified_base (389)..(389): a, c, t, g, unknown or other
  modified_base (406)..(406): a, c, t, g, unknown or other
  modified_base (430)..(430): a, c, t, g, unknown or other
  modified_base (432)..(432): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgngttttctaggtggctattttaaaacgtgtcagtgtgaggtgcagctggcggagtctgggggaggcctggtacagccgggggggtccctgagactctcctgtgtagcctccggattcacctttagcagacatggcatgagctgggtccgccaggctccaggggaaggggccggagtggggtgtcagtcattagtagtagtggtgatagatttaccanacagactccgtagaaggggccncttcaccatctctaganacactacacacacactatatctananaatagtagtagacgagagacgacgacgacgacgacgtacttacttacgtacgacgacgaagtaacgtacgtacggtacgaacgaacggtacggtacgtacgtacgtttacgtacgtacgtcg

SEQ ID NO: 373700 - DNA, 563 bp, Homo sapiens
  misc_feature: GZ8MTXP02IAGN4.22.82.H05.1.454.CMB.2.raw
  modified_base (286)..(286): a, c, t, g, unknown or other
  modified_base (321)..(321): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctattttaaaacgtgtcagtgtgaggtgcagctggcggagtctgggggaggcctggtacaggccggggggtcctgagctctcctgtgtagcctccggattcacctttagcagacatggcatgngcgtcggtccgcgacgcgcgaggggacggggcggnggtgggtgtgagtctagtagtagtagtggtgagtagtaatacacacacgctacgtacgacggcgtctcacactctcagagactaactaccaacaacacactatatactagactaaatagtagtagacgagagacgacgacgacgacgtacgtacttacttacgtacgacgacgaaggtaacgtacgtacggtacggtaacgtaacggtacggtacgtacgtacgtttacgttacgtacgtcg

SEQ ID NO: 373701 - DNA, 547 bp, Homo sapiens
  misc_feature: GZ8MTXP02G8IGK.22.82.H05.1.454.CMB.2.raw
  modified_base (151)..(151): a, c, t, g, unknown or other
  modified_base (388)..(388): a, c, t, g, unknown or other
  modified_base (405)..(405): a, c, t, g, unknown or other
  modified_base (429)..(429): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgngttttctaggtggctatttaaaacgtgtcagtgtgaggtgcagctggcggagtctgggggaggcctggtacaggccgggggggtccctgagactctcctgtgtagcctccggattcacctttagcagacatggcatgagctgggccgccaggctccgaggggaaggggccggagtggggtgtcagtcattagtagtagtggtgatagaatttacacacagactccgtgaaggggccncttcaccatctctaganacactacacacacactatatctanacaatagtagtagacgtagagacgacgacgacgacgacgtacttattactcgacgacgagaacgtacgtacggtacgacgaacggtacggtacgtacgtacgttacgtacgtacgtcg

SEQ ID NO: 373702 - DNA, 630 bp, Homo sapiens
  misc_feature: GZ8MTXP02GCL3L.22.82.H05.1.454.CMB.2.raw
  modified_base (151)..(151): a, c, t, g, unknown or other
  modified_base (178)..(178): a, c, t, g, unknown or other
  modified_base (284)..(286): a, c, t, g, unknown or other
  modified_base (288)..(288): a, c, t, g, unknown or other
  modified_base (319)..(319): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgngttttctaggtggctattttaaaacgngtcagtgtgaggtgcagctggcggagtctgggggagcctggtacaggccgggggggtccctgagctctcctgtgtagcctccggattcacctttagcagacatggnnngngcgtcggtccgcgcgcgcgagggagggcggnggtggtgtcgtagtgtagtagtagtagtggtagtagtagtaacttacaacacacgcgtacgtacggacggccgtctacaccactactacgtaacgacgaactaactacccaacgaacaactactacgtactactacgaactaaagtacgtacgtacggtacgtacgacggacggaccgaaccgaaccgaccggtaccgtaacgtttaacgttaacgtacgtacggtaacggtaaacggtaacgtaacggtaaccgggtaacggtaacggtaacggtacggtacgtacggttacgttacgtacgtacgtacg

SEQ ID NO: 373703 - DNA, 585 bp, Homo sapiens
  misc_feature: GZ8MTXP02GHI69.22.82.H05.1.454.CMB.2.raw
  modified_base (285)..(285): a, c, t, g, unknown or other
  modified_base (287)..(287): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgttttctagtggctattttaaaacgtgtccagtgtgaggtgcagctggcggagtctgggggaggcctggtacagccgggggggtccctgagactctcctgtgtagcctccggattcacctttagcagacatggnangagcgtggtccgccgacgctccgaggggaggggcggaggtgggtgtcgagtctagttagtagtaggtggtgtatagtaattacacacacgctcgtaggacggccgtctcacactctactagagaacaactacccaacgaacaacaactagtatactacgacaaatagtacgtaggacgtagagacgaccgaaccgaaccgaaccgacctaactttaattactacgacgacggaaaggaacgtacgtaacggtacggaacgtaacggtacggacgtacgtacgttacgtacgtacgtcg

SEQ ID NO: 373704 - DNA, 592 bp, Homo sapiens
  misc_feature: GZ8MTXP02G7Y9D.22.82.H05.1.454.CMB.2.raw
  modified_base (303)..(303): a, c, t, g, unknown or other
  modified_base (373)..(373): a, c, t, g, unknown or other
  modified_base (409)..(409): a, c, t, g, unknown or other
  modified_base (416)..(416): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctattttaaaacgtgtccagtgtgaggtgcagctggcggagtcgtgggggaggcctggtacaggccgggggggtccctgagctctcctgtgtagcctcggattcacctttagcagacatggcatgagctggggtccncaggctccgaggggaaggggccggagtggggtgtcaggtcagttagtagtagtggtgatagatttaccanacagactccgtgaaacgggccgcttacaccatcctntaggaanaacaactaccaagaaccacactagtactctagacaaactacgtacgtacgtacgtagacggacgaccggacgaccgaccgaccgtacgttaacttacgtacgacgacggaacggtaacgtacgtacggtacggaacgtaacggtacggtacgtacgtacgttacgtacgtacgtcg

SEQ ID NO: 373705 - DNA, 547 bp, Homo sapiens
  misc_feature: GZ8MTXP02GV40E.22.82.H05.1.454.CMB.2.raw
  modified_base (398)..(398): a, c, t, g, unknown or other
  modified_base (416)..(416): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttagtggctattttaaaacgtgtccagtgtgaggtgcagctggcggagtcgtgggggaggcctggtacaggccgggggggtccctggagactctcctgtgtagcctccggattcacctttagcagacatggcatgagctgggtccgccaggctccgaggggaaggggccggaggtggggtgtcagtcattagtagtagtggtgatagaatttaccacacagactccgagaacggggccncttcaccatctactaganacaattcccagaacacacttgatcagacaatagagaggacgagagagacgacgacgacgactattatactacgcgacgagagtacgtacggtacgacgaacggacgacgtacgtacgtacgtacgtactcg

SEQ ID NO: 373706 - DNA, 582 bp, Homo sapiens
  misc_feature: GZ8MTXP02G4UE7.22.82.H05.1.454.CMB.2.raw
  modified_base (300)..(300): a, c, t, g, unknown or other
  modified_base (373)..(373): a, c, t, g, unknown or other
  modified_base (405)..(405): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctaggtggctattttaaaacgtgtcagtgtgaggtgcagctggcggagtcgtgggggaggcctggtacaggccgggggggtccctgagactctcctgtgtagcctccggattcacctttagcagacatggcatgagctgggccncaggctccgaggggaaggggccggagtggggtgtcaggtcattagtagtagtggtgatagaatttacacacanactccgtgaaggcgcttcacactctctagaanacaactaccaacaacacactactactactacgactaaatacgtacgtacgtacgtagagacgaccgacgaacgacgaccgtacttaacttacgtacgacgacggaaaggtaacgtacggtacgggtaacggaacggtaacggtacggtacggtacgtacgttacgttacgtacgtcg

SEQ ID NO: 373707 - DNA, 555 bp, Homo sapiens
  misc_feature: GZ8MTXP02GHRBD.22.82.H05.1.454.CMB.2.raw
  modified_base (372)..(372): a, c, t, g, unknown or other
  modified_base (394)..(394): a, c, t, g, unknown or other
  modified_base (412)..(412): a, c, t, g, unknown or other
  modified_base (423)..(423): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgcgttttctaggtggctattttaaaacgtgtccagtgtgaggtgcagctggcggagtctgggggaggcctggtacaggccgggggggtccctgagactctcctgtgtagcctccggattcacctttagcagacatggcatgagctgggtccgccagggctccaggggaaggggccggaggtggggtgtcaggtcattagtagtagtggtgatagatttaccanacagactccgtgaaaggggccncttcaccatctctagaanactactcccanacacatagtatctagacaatagacgtagacgagagacgacgacgacgacgactacttacttactagcgacgaaggagtacgtacggtacgacgtaacggtacggtacgtacgtacgttacgtacgtacgtcg

SEQ ID NO: 373708 - DNA, 568 bp, Homo sapiens
  misc_feature: GZ8MTXP02HOB01.22.82.H05.1.454.CMB.2.raw
  modified_base (374)..(374): a, c, t, g, unknown or other
  modified_base (412)..(412): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctaattttaaacgtgtcagtgtgaggtgcagctggcggagtcgtgggggaggcctggtacgaggccgggggggtccctgagactctcctgtgtagcctccggattcacctttagcagacatggcatgagctgggccgcaggctccgaggggaggggccggaggtgggtgtcagtctagttagtagtagtggtagatagtaattaccanacagactccgtgaacgggcctcttacaccatctcaganacattcccaagaaccacactgtatctagacaaatagtactaggacgtagagacgacgacgacgacgactacttacttacgtacgacgacgaaggtaacgtacgtacggtacgaacgtaacggtacggtacgtacgtacgtttacgtacgtacgtcg

SEQ ID NO: 373709 - DNA, 573 bp, Homo sapiens
  misc_feature: GZ8MTXP02H2JJ5.22.82.H05.1.454.CMB.2.raw
  modified_base (375)..(375): a, c, t, g, unknown or other
  modified_base (396)..(396): a, c, t, g, unknown or other
  modified_base (415)..(415): a, c, t, g, unknown or other
  modified_base (449)..(449): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttaggtggctattttaaaacgtgtccagtgtgaggtgcagctggcggagtcgtgggggaggcctggtacaggccgggggggtccctgagactcgtcctgtgtagcctccggattcacctttagcagacatggcatgagctgggtccgccaggctccgaggggaaggggccggaggtgggtgtcaggtcattagtagtagtggtgatagatttacanacagctccgtgaacgggccgnttcacctatcactaggaanactaattccccaagaaaccacaactgtaatctanacaaatagtacgtagacgagagacgacgacgacgacgactattacttacgtacgacgacgaaggaacgtacgtacggtacggacgaacggtacggtacgtacgtacgtttacgtacgtacgtcg

SEQ ID NO: 373710 - DNA, 638 bp, Homo sapiens
  misc_feature: GZ8MTXP02HI7Q4.22.82.H05.1.454.CMB.2.raw
  modified_base (283)..(283): a, c, t, g, unknown or other
  modified_base (285)..(285): a, c, t, g, unknown or other
  modified_base (287)..(287): a, c, t, g, unknown or other
  modified_base (289)..(289): a, c, t, g, unknown or other
  modified_base (325)..(325): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctatttaaacgtgtcagtgtgaggtgcagctggcggagtcgtgggggagcctggtacaggcccgggggggtccctggagactctcctgtgtagcctccggattcacctttagcagacagngnangngcgtcggtccgccgcgcgcggaggggacggggcggnggtggtgtcgtagtgtagtagtagtaggtggtagtagtagtaacttaactaacacgaacgtaccgtaccgtacggacggccgtccgtacctacctactctacgtagaacgaactaactacccaacgaaacaactaactacgtactactacgtacgtaaacgtacgtaacgtagtacgtagagacgaccgaccgaccgaccgtaccgtactttaacgttacgtacgacggaacggtaaacggtaaacgtaacggtaacgggtaacggtaacggtaacggtacggtacgtacgttacgttacgtacgtacgtacg

SEQ ID NO: 373711 - DNA, 579 bp, Homo sapiens
  misc_feature: GZ8MTXP02JROSM.22.82.H05.1.454.CMB.2.raw
  modified_base (372)..(372): a, c, t, g, unknown or other
  modified_base (397)..(397): a, c, t, g, unknown or other
  modified_base (409)..(409): a, c, t, g, unknown or other
  modified_base (436)..(436): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctattttaaaacgtgtcagtgtgaggtgcagctggcggagtcgtgggggaggcctggtacaggccgggggggtcctgagactctctgtgtagcctccggattcacctttagcagacatggcatgagctgggtccgccaggctccgaggggaacggggccggagtgggtgtcaggtcattagtagtagtggtcgatagaatttaccanacagacctccggtgaaacggggccnttcaccatcctntagagacaattcccaagaacacacttntatctagactaaatcgacgtaggctagacgacgaccgacgacgaccggtactaatttactacgtggacggacggaaaggtactaacggtaccgggtacgaacggtaacggtcggtaccgtacggtcgtttacgtacgtactcg

SEQ ID NO: 373712 - DNA, 565 bp, Homo sapiens
  misc_feature: GZ8MTXP02GP6O1.22.82.H05.1.454.CMB.2.raw
  modified_base (371)..(371): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccgggggggtccctgagactctcctgtgtagcctccggattcacctttagcagacatggcatgagctgggtccgccaggctccgaggggaaggggccggagtgggtgtcgagtcattagtagtagtggtgatagaatttaccanacagactccgtagaacgggccgcttcaccatctctagagacaattcccagaacacactgtatctagacaaatgactagggcctagacgacgaccgacgacgaccgtacttattactacgtcgacgaacggaagtacgtacgggtacggacgaacggtaacggtcgtacgtaccgttacgttacgaagtcgtccg

SEQ ID NO: 373713 - DNA, 571 bp, Homo sapiens
  misc_feature: GZ8MTXP02I2SG6.22.82.H05.1.454.CMB.2.raw
  modified_base (300)..(300): a, c, t, g, unknown or other
  modified_base (370)..(370): a, c, t, g, unknown or other
  modified_base (395)..(395): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctattttaaacgtgtcagtgtgaggtgcagctggcggagtcgtgggggaggcctggtacaggccggggggtcctgagactctcctgtgtagcctccggattcacctttagcagacatggcatgagctggggccncaggctccgaggggaaggggccggagtggggtgtcagtcattagtagtaggtggtgatagtaattaccanacagacctccgtagaacggggcccncttacacctatctactaggacactaacttcccaagaaccacactagtatccttaaaacaatacgacgtagactagagacgaccgacgacgacgacttattactacgcgacgagaaggtatacggtaccggtacgaacgtacgggtcgtacgtacggtcgtttactacgtactcgcg

SEQ ID NO: 373714 - DNA, 562 bp, Homo sapiens
  misc_feature: GZ8MTXP02J2MX6.22.82.H05.1.454.CMB.2.raw
  modified_base (461)..(461): a, c, t, g, unknown or other
  modified_base (490)..(490): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccgggggggtccctggagactctcctgtgtagcctccggattcacctttagcagacatggcatgagctggggtccgccaggcctccgaggggaaggggccggaggtgggtgtcgagtcattagtagtagtggtgatagaatttaccacacagctccgtaggaacgggccgcttcaccatctctagacgacaattccccagaacacactgtatctgacaaatgactaggctaganacgcgacgacacggcctaatttacttacngccgacggaaaggactagtaaccggggtcgaaacgaacgggttggacttacggtcgttttcaacggtactcg

SEQ ID NO: 373715 - DNA, 549 bp, Homo sapiens
  misc_feature: GZ8MTXP02GD6MC.22.82.H05.1.454.CMB.2.raw
  modified_base (151)..(151): a, c, t, g, unknown or other
  modified_base (224)..(224): a, c, t, g, unknown or other
  modified_base (298)..(298): a, c, t, g, unknown or other
  modified_base (356)..(356): a, c, t, g, unknown or other
  modified_base (382)..(382): a, c, t, g, unknown or other
  modified_base (393)..(393): a, c, t, g, unknown or other
  modified_base (409)..(409): a, c, t, g, unknown or other
  modified_base (416)..(416): a, c, t, g, unknown or other
  modified_base (423)..(423): a, c, t, g, unknown or other
  modified_base (429)..(429): a, c, t, g, unknown or other
  modified_base (431)..(431): a, c, t, g, unknown or other
  modified_base (434)..(434): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgngtttctaggtggctattttaaaacgtgtccagtgtgaggtgcagctggcggagtctgggggaggcctggtacnggccgggggggtccctgagctctcctgtgtagcctccggattcacctttagcagacatggcatgagctgggccnccaggctccgaggggaaggggccggagtggggtgtcgaggtcatttagagtagtggtnatagaatttaccacacagacttccgngaaaggggccncttcaccatctcaganacatcanacacatnatctananaanagagagagagagacgacgacgacgacgactattacttacgtacgacgacgaagtaacgtacgtacggtacgtaacgtaacggtacggtacgtacgtacgttacgtacgtacgtcg

SEQ ID NO: 373716 - DNA, 560 bp, Homo sapiens
  misc_feature: GZ8MTXP02H8APV.22.82.H05.1.454.CMB.2.raw
  modified_base (393)..(393): a, c, t, g, unknown or other
  modified_base (407)..(407): a, c, t, g, unknown or other
  modified_base (423)..(423): a, c, t, g, unknown or other
  modified_base (431)..(431): a, c, t, g, unknown or other
  modified_base (439)..(439): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctattttaaacgtgtccagtgtgaggtgcagctggcggagtcgtgggggaggcctggtacaggccgggggggtccctgagactctcctgtgtagcctccggattcacctttagcagacatggcatgagctgggccgcaggctccgaggggaaggggccggagtggggtgtcaggtcattagtagtagtggtgatagaatttaccacacagctccgtgaaacggggccncttcaccatcctanagacactactaccaanacacactntactctanacaatagtacgtagacgagagacgacgacgacgacgactacttacttactacgacgacgaagtacgtacgtacggtacgacgtaacggtacggtacgtacgtacgttacgtacgtacgtcg

SEQ ID NO: 373717 - DNA, 542 bp, Homo sapiens
  misc_feature: GZ8MTXP02J1P0C.22.82.H05.1.454.CMB.2.raw
  modified_base (370)..(370): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacaggccgggggggtccctgagactctcctgtgtagcctccggattcacctttagcagacatggcatgagctgggtccgccaggctccgaggggaaggggccggagtggggtgtcagtcattagtagtagtggtgatagaatttaccanacagactccgtagaagggccgcttcaccatctctagacgacaacttccccagaacacactgtatctagcaaatgactaggctagagagccgacgacacggccatttatactgcgacggaaggatacgtacggggtcaacgaacgggtcgacgtacgtcgtttactacgatcg

SEQ ID NO: 373718 - DNA, 550 bp, Homo sapiens
  misc_feature: GZ8MTXP02HQW0F.22.82.H05.1.454.CMB.2.raw
  modified_base (370)..(370): a, c, t, g, unknown or other
  modified_base (391)..(391): a, c, t, g, unknown or other
  modified_base (406)..(406): a, c, t, g, unknown or other
  modified_base (415)..(415): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggcgtttttcttagtggctattttaaaacgtgtccagtgtgaggtgcagctggcggagtctgggggaggcctggtacagccgggggggtccctgagactctcctgtgtagcctccggattcacctttagcagacatggcatgagctgggtccgccaggctccagggaaggggccggagtggggtgtcagtcattagtagtagtggtgatagaatttaccanacagactccgtgaagggccgnttcaccatctcaganacactccanacacactgtatctagataatagtacgtagacgtagagacgaccgacgacgacgactacttacttactacgcgacgaaggacgtacgtacggtacgacgaacggtacggacgtacgtacgttacgtacgtacgtcg

SEQ ID NO: 373719 - DNA, 555 bp, Homo sapiens
  misc_feature: GZ8MTXP02HM20W.22.82.H05.1.454.CMB.2.raw
  modified_base (273)..(273): a, c, t, g, unknown or other
  modified_base (275)..(277): a, c, t, g, unknown or other
  modified_base (279)..(279): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctatttaaaacgtgtcagtgtgaggtgcagctggcggagtcgtgggggagcctggtacaggccggggggtcctgagctctctgtgtagcctcggattcacttagcagcangnnngngcgtcggcgcgcgcgcgagggacgggcggaggtggtgtgagtagtagtagtagtagtggtagtagtagtaattacacacacgacgtacgtaggacggaccgtctacacactctactacgacgaactaactaccacgaacaacaactagtactactacgtactaaatagtacgtagagagagacgacgacgacgacgactattatactacgacgacgaagaacgtacgtacggtacgacgaacggtacgtacgtacgtacgttacgtacgtacgtcg

SEQ ID NO: 373720 - DNA, 622 bp, Homo sapiens
  misc_feature: GZ8MTXP02JPD27.22.82.H05.1.454.CMB.2.raw
  modified_base (445)..(445): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttgtggctaattttaaaacgtgtccagtgtgaggtgcagctggcggagtcgtgggggaggcctggtacaggcccgggggggtcctggagactctcctgtgtagcctcggattcacctttagcagacatggcatgagctgggtccgccaggctccgaggggaaggggccggagtggggtgtcaggtcagttagtagtagtggtagatagaaatttaccgacacagaccgtccgtaggaaacggggcccgtcttaccacctatccgtctaagagacaattccccaaanaaccactactagtactctacgacaaagtcgaacgtaggactaggacgacggaccgacgacgtaccggtacttaagtttacttacgtacgacggaacggaaagtaacgtaacggtaccggggtacgaaacggtaaccgggtacgaccgttacggttacgtttacgtaacgtacgttcg

SEQ ID NO: 373721 - DNA, 573 bp, Homo sapiens
  misc_feature: GZ8MTXP02FTN5A.22.82.H05.1.454.CMB.2.raw
  modified_base (272)..(272): a, c, t, g, unknown or other
  modified_base (274)..(275): a, c, t, g, unknown or other
  modified_base (277)..(279): a, c, t, g, unknown or other
  modified_base (281)..(281): a, c, t, g, unknown or other
  modified_base (283)..(283): a, c, t, g, unknown or other
  modified_base (307)..(307): a, c, t, g, unknown or other
  modified_base (389)..(389): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctatttaaaacgtgtcagtgtgaggtgcagctggcggagtcgtgggggaggcctggtacaggccggggggtcctgagactctcctgtgtagcctcggatcacttagcananngnnngngngcgcgcgcgcgcgaggagggcggnggtggtgtcgagtgtagtagtagtagtggtgagtagtaattacacacacgcgtcgagacggccgtctcacactactctaganaacaactaccaacaacaacactatactactagacaaatacgtaacgtacggtacgtagaacgacgaccgaacgaacgaaccgaccgtaactttaacttacgttacgacgacggaaacggtaaacgtaacgtaacggtacggaacggaacggtacggtacgtacgtacgttacgtacgtacgtcg

SEQ ID NO: 373722 - DNA, 554 bp, Homo sapiens
  misc_feature: GZ8MTXP02IH9YE.22.82.H05.1.454.CMB.2.raw
  modified_base (151)..(151): a, c, t, g, unknown or other
  modified_base (274)..(274): a, c, t, g, unknown or other
  modified_base (276)..(276): a, c, t, g, unknown or other
  modified_base (278)..(278): a, c, t, g, unknown or other
  modified_base (311)..(311): a, c, t, g, unknown or other
  modified_base (324)..(324): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgngtttctagtggctattttaaacgtgtcagtgtgaggtgcagctggcggagtctgggggagcctggtacagccggggggtccctgagctctctgtgtagcctccggattcactttagcagacangnangagcgtcggtccgcgcgcgcgaggacgggcggnggtggtgtgagtntagtagtagtagtgtgtagtagtacttacacacacgcgtcgtacgacggccgtctcacactctctagacgactaactaccacaacaacactagtactactacaactaaatagtacgtaggtacgtagagacgacgacgacgacgtactacttacttacgtacgacgacgaagtacgtacgtacggtacgacgtaacggtacgtacgtacgtacgttacgtacgtacgtcg

SEQ ID NO: 373723 - DNA, 631 bp, Homo sapiens
  misc_feature: GZ8MTXP02FS7Z8.22.82.H05.1.454.CMB.2.raw
  modified_base (289)..(289): a, c, t, g, unknown or other
  modified_base (308)..(308): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagttttgggctgagcgtggcgttttctaggtggctattttaaaacgtgtccagtgtgaggtgcagctgcggagtctgggggaggcctggtacagccgggggggtccctgagactctcctgtgtagcctccgggatcacctttagcagacatggcangagcgtggtccgccgagcnccgaggggagggggccggaggtgggtggtcgagtctagttagtaggtaggtggtgagtagtaattaccacacagctccgtaggaggcgctcaccatctactagagacaactacccacaaacaacactagtatctagacaaatagaacgtacggtacgtagacgaacggacccggaaccgaaccgaaccggacccgtaactttaaactttaacgttacgaccggaaccggaaacggtaaacgtaaacgttaaccggggtaaccggaaaccgaaaaccgggtacgggtaccgtaaccggtaccggtttacgttaacgtacgtacg

SEQ ID NO: 373724 - DNA, 561 bp, Homo sapiens
  misc_feature: GZ8MTXP02JP5U4.22.82.H05.1.454.CMB.2.raw
  modified_base (442)..(442): a, c, t, g, unknown or other
  modified_base (444)..(444): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgcgttttctagtggctattttaaaacgtgtccagtgtgaggtgcagctggcggagtctgggggaggcctggtacagccggggggggtccctgagactctcctgtgtagcctccggattcacctttagcagacatggcatgagctgggtccgccgaggctccacgggaaggggccggaggtggggtggtcgagtcgattagtagtagtggtgatagaattactacacagactccgtgaaggccggcttcaccactctcctagagacaacttacccacaacacactagtatctananaatagagtagacgagagacgacgacgacgacgactacttacttacgtacgcgacgaggtacgtacgtacggtacggacgaacggtacggtacgtacgtacgttacgtacgtacgtcg

SEQ ID NO: 373725 - DNA, 561 bp, Homo sapiens
  misc_feature: GZ8MTXP02GHHW8.22.82.H05.1.454.CMB.2.raw
  modified_base (289)..(289): a, c, t, g, unknown or other
tcagacatacgcgtcacgaccggtgctcgatttagtcgagctctctcgcggggtctgagagaggagcccagacctgggattttcaggtgttttcatttggtgatcaggactgaacagagagaactcaccatggagtttgggctgagcgtggcgttttctaggtggctattttaaaacgtgtccagtgtgaggtgcagctggcggagtctgggggagcctggtacaggccgggggggtccctgagctctcctgtgtgcctccggattcacctttagcagacatggcatgngcgtcggccgcgacgcgcgagggacggggcggaggtggtgtcgagtgtagttagtagtagtggtgtagtagtattacacacacgctcgtgacggccgctcacactctactagacgaactactaccacaacacactatactactacactaagtagtacgtacgacgtagagacgaccgacgacgacgtactacttacttacgtacgacgacgaagacgtacgtacggtacgacgtaacggtacggtacgtacgtacgttacgtacgtacgtcg

SEQ ID NO: 373726 - DNA, 547 bp, Homo sapiens
  misc_feature: GZ8MTXP02HJB36.22.82.H05.1.454.CMB.2.raw
  modified_base (378)..(378): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttaggtggctattttaaaacgtgtccagtgtgaggtgcagctggcggagtcgtgggggaggcctggtacaggccgggggggtccctgagactctcctgtgtagcctccggattcacctttagcagacatggcatgagctggggtccgccaggctccgaggggaaggggccggaggtggggtgtcagtcagttagtagtagtggtgatagaatttaccanacagctccgtgaagggccgcttcaccatctctagagacaattcccagaacacactagtatctgacaaatagtactagacgtgagaaggcgacgacgacggccattattactgcgacgagagtagtacggtacgacgaacggtggcgtacgtcgttcgtacgttacgtcg

SEQ ID NO: 373727 - DNA, 593 bp, Homo sapiens
  misc_feature: GZ8MTXP02ITBCA.22.82.H05.1.454.CMB.2.raw
  modified_base (151)..(151): a, c, t, g, unknown or other
  modified_base (175)..(175): a, c, t, g, unknown or other
  modified_base (282)..(282): a, c, t, g, unknown or other
  modified_base (284)..(284): a, c, t, g, unknown or other
  modified_base (286)..(286): a, c, t, g, unknown or other
  modified_base (319)..(319): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgngtttctaggtggctatttaaacgngtcagtgtgaggtgcagctggcggagtctgggggagcctggtacaggccgggggggtccctggagctctcctgtgtagcctccggattcacctttagcagacatggnangngcgtcggtccgcgcgcgcgacgggacgggcggnggtggtgtcgtagtgtagtagtagtagtggtagtagtagtaacttactacacgacgtcgtacgtacggacggaccgtaccgtactacctactactacgtagacgaactaactaccaacgaacaactactacgtactacgtacgactaacgtacgtacgtacgtacgtagagacgacgacgacgacgtactacttacgtacgtacgacgacgaacgtacgtacgtacggtacgacgtaacggtacggtacgtacgtacgttacgtacgtacgtcg

SEQ ID NO: 373728 - DNA, 553 bp, Homo sapiens
  misc_feature: GZ8MTXP02F2D7A.22.82.H05.1.454.CMB.2.raw
  modified_base (393)..(393): a, c, t, g, unknown or other
  modified_base (410)..(410): a, c, t, g, unknown or other
  modified_base (431)..(431): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggcgttttctagtggctattttaaaacgtgtccagtgtgaggtgcagctggcggagtcgtgggggaggcctggtacaggccgggggggtccctgagactctcctgtgtagcctccggattcacctttagcagacatggcatgagctgggtccgccaggctccgaggggaaggggccggagtggggtgtcgagtcattagtagtagtggtgatagaatttaccacacagctccgtgaaggggccncttcaccatctctaganacaattcccaagaacacactntactctagacaaatagactagacgagagagacgacgacgacggacctacttattaactgacgacgaaggaacgtagtacggtacgacgaaccggtaggacgtacgtacgttctacgtagtcg

SEQ ID NO: 373729 - DNA, 558 bp, Homo sapiens
  misc_feature: GZ8MTXP02FO4J9.22.82.H05.1.454.CMB.2.raw
  modified_base (372)..(372): a, c, t, g, unknown or other
  modified_base (383)..(383): a, c, t, g, unknown or other
  modified_base (394)..(394): a, c, t, g, unknown or other
  modified_base (440)..(440): a, c, t, g, unknown or other
  modified_base (442)..(442): a, c, t, g, unknown or other
  modified_base (445)..(445): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctattttaaaacgtgtccagtgtgaggtgcagctggcggagtcgtgggggaggcctggtacaggccgggggggtccctgagactctcctgtgtagcctccggattcacctttagcagacatggcatgagctgggtccgccaggctccgaggggaaggggccggaggtgggtgtcaggtcattagagtagtggtgatagaatttacanacagactccgngaacggggccncttcaccatctctagagacaattcccaagaacacaactgtatctananaanagagtagacagagacgacgacgacgacgactacttacttactacgacgacgaagaacgtacgtacggtacgaacgaacggtacggtacgtacgtacgttacgtacgtacgtcg

SEQ ID NO: 373730 - DNA, 560 bp, Homo sapiens
  misc_feature: GZ8MTXP02J2LYV.22.82.H05.1.454.CMB.2.raw
  modified_base (377)..(377): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaacgtgtccagtgtgaggtgcagctggcggagtcgtgggggaggcctggtacgaggcccggggggtccctgagactctcctgtgtagcctccggattcacctttagcagacatggcatgagcgtggggtccgccgaggctccgaggggaaggggccggaggtggggtgcgagtcattagtagtaggtggtgatagaatttaccanacagctccgtaggaacgggccgtcttcgaccatcctctagacgaacaacttccccagaaaccacactagtactctagacaaatgactaggctagagacgaccgacgacacggctagtttatactgccgacggaagatacgtaccgggtacgaacgaacggtggactacgtcgtttacagctcg

SEQ ID NO: 373731 - DNA, 560 bp, Homo sapiens
  misc_feature: GZ8MTXP02JU82S.22.82.H05.1.454.CMB.2.raw
  modified_base (288)..(288): a, c, t, g, unknown or other
  modified_base (290)..(290): a, c, t, g, unknown or other
  modified_base (326)..(326): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggcgttttctagtggctattttaaaacgtgtcagtgtgaggtgcagctggcggagtcgtgggggaggcctgggtacaggccgggggggtccctggagactctcctgtgtagcctcggattcacctttagcagacatggnangagcgtcggtccgcgcgcgcggagggacggggcggnggtgggtgtgagtgtagtagtagtagtggtagatagtattacacacacgcgtcgtacggacggccgtctacacactctactagacgactaactaccacaacacactactatactagacaatagagtagagagagacgacgacgacgacgactacttacttacgtacgacgacgaagacgtacgtacggtacgacgtaacggtacggtacgtacgtacgttacgtacgtacgtcg

SEQ ID NO: 373732 - DNA, 611 bp, Homo sapiens
  misc_feature: GZ8MTXP02HGPLW.22.82.H05.1.454.CMB.2.raw
  modified_base (290)..(290): a, c, t, g, unknown or other
  modified_base (292)..(292): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctaggtggctattttaaacgtgtccagtgtgaggtgcagctggcggagtcgtggggggaggcctggtacgaggccgggggggtcctggagctctcctgtgtagcctccggattcacctttagcagacatggcangngcgtcggtccgcgcgcgcggacgggacgggcggaggtggtgtcgtagtgtagtagtagtaggtggtagtagtagtaacttactacacgacgtcgtacgtacggacggccgtctacactactactactagacgactactaccacgaacactactacgtactactacgactaacgtacgtacgtacgtacgtagacgacgaccgacgacgaccgtacgtaacgttacgttacgtacgacgtacggtaacggtaacgtacggtaacggtaacggtaacggtaacggtacggtacgtacgttacgttacgttacgtacgtacg

SEQ ID NO: 373733 - DNA, 569 bp, Homo sapiens
  misc_feature: GZ8MTXP02H1EQE.22.82.H05.1.454.CMB.2.raw
  modified_base (361)..(361): a, c, t, g, unknown or other
  modified_base (376)..(376): a, c, t, g, unknown or other
  modified_base (415)..(415): a, c, t, g, unknown or other
  modified_base (433)..(433): a, c, t, g, unknown or other
  modified_base (438)..(438): a, c, t, g, unknown or other
  modified_base (464)..(464): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttagtggctaattttaaaacgtgtccagtgtgaggtgcagctggcggagtcgtgggggaggcctggtacgaggccgggggggtccctgagactctcctgtgtagcctccggattcacctttagcagacatggcatgagctggtccgcaggctccgaggggaaggggccggagtggggtgtcgagtcagttagtagtagtggngatagaatttaccanacagctcgtgaaacgggccgacttcacctatctataganactaatcccaagaaccanacgtntatctagactaaatcgaactacgggngagagacgacgacgacgacgactacttacttacgtacgcgacgaagtaacgtacgtacggtacgacgaacggtacggtacgtacgtacgttacgtacgtacgtcg

SEQ ID NO: 373734 - DNA, 572 bp, Homo sapiens
  misc_feature: GZ8MTXP02JLQ5Q.22.82.H05.1.454.CMB.2.raw
  modified_base (569)..(569): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaaacgtgtccagtgtgaggtgcagctggcggagtcgtgggggaggcctggtacgaggccgggggggtccctgagactctcctgtgtagcctccggattcacctttagcagacatggcatgagctggggtcccgccgaggcctccgaggggaacggggccggaggtggggtgtcgagtcagttagtagtagtggtgatagaatttaccacacagctccgtaggaacgggcccgcttcaccatctactagacactaacttcccaagaaccacactgtatctagacaaatgaactaaggctagagacgacccgaacgacacgggacctaatttacttactggacgacggaaaggatacgtaccgggtacgaacgaacgggtgactacggcgtttcaaggtntcg

SEQ ID NO: 373735 - DNA, 567 bp, Homo sapiens
  misc_feature: GZ8MTXP02JP4R8.22.82.H05.1.454.CMB.2.raw
  modified_base (498)..(498): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaaacgtgtccagtgtgaggtgcagctggcggagtcgtgggggaggcctggtacaggccgggggggtccctgagactctcctgtgtagcctccggattcacctttagcagacatggcatgagctgggtccgccaggctccgaggggaaggggccggagtgggtgtcgagtcagttagtagtagtggtgatagaattaccacacagctccgtagaacgggccgcttacaccatctctagagacaattcccagaaccacactgtaatctagacaaaatgaactagggctgaagagacccgaacgactaccgggcctaagtttacttaacngccggacgaaagggtatacgtacgggggtcaaacgaacgggtgacctacggtcgttttacaaggtctcg

SEQ ID NO: 373736 - DNA, 684 bp, Homo sapiens
  misc_feature: GZ8MTXP02H4VX5.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcacatggagtttgggctgagcgtggtctttttcttgtggcttaattttaaaacgtgtccagtgtgaggtgcagctggcggagtcgtgggggaggccgtggtacgaggccgggggggtccctgagactctcctgtgtacgcctcggattcaccttagcagacatggcatgagcgtcggggtcccgccaggccgtccggaaggggaacggggccggaggtgggtgtcgagtcagttagtagtagtggtagataagtaattaccacacgagaccgttccggaggaaacgggcccgtacttaccaaccctaactccttacgtaagaacgaaacctaaacttcccccgaaagaaacccaacaacttagtactcctagacaaaagttcgaaacgtaggcgtagaacggacgacccgaaacggtaaccgaccggtacctaatttaaacttacgacgaccgggaaacgaaaagggtacttaaaccggtaccgggggtaccgaaaacccgggtaaacgggttcgggtaaccgttaaccggtccgtttttaccgtaaaggactttccgg

SEQ ID NO: 373737 - DNA, 608 bp, Homo sapiens
  misc_feature: GZ8MTXP02H3E3G.22.82.H05.1.454.CMB.2.raw
  modified_base (278)..(279): a, c, t, g, unknown or other
  modified_base (281)..(281): a, c, t, g, unknown or other
  modified_base (283)..(283): a, c, t, g, unknown or other
  modified_base (285)..(285): a, c, t, g, unknown or other
  modified_base (316)..(316): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctattttaaaacgtgtcagtgtgaggtgcagctggcgagtctgggggaggcctggtacaggccgggggggtcctgagactctcctgtgtgcctccggattcacctttagcagacnngnangngcgtcggtcgcgcgcgcgagggacgggcggnggtggtgtgtagtagtagtagtagtagtggtgtagtagtaactactacacacgtacgtacgtacggacggaccgtcctactactactactactagacgaactaactaccaacaacaactactacgtactactagactaatagtacgtagacgagagacgaccgacgacgaccgtacgtacttaacgttacgtacgtacggacgtaaacggtaacggtaacggtaaccgggtaaccggtaaccggtaacggtacggtaccggttaccggttacgtttacgttacgtacgtacg

SEQ ID NO: 373738 - DNA, 580 bp, Homo sapiens
  misc_feature: GZ8MTXP02JKVZG.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttaggtggctaattttaaaacgtgtccagtgtgaggtgcagctggcggagtcgtgggggaggccgtggtacaggccgggggggtccctgagactctcctgtgtagcctccggattcacctttagcagacatggcatgagctggggtcccgccaggcctccgaggggaaggggccggaggtgggtgtcgagtcattagtagtaggtggtgatagtaatttaccacacagactccgtagaacggggccgcttcaccatctactagagaacaattcccagaaccacactgtatctagacaaatgactaggctagagacgaccgacgaacgaccggacctatttactactggacccgacggaaaggtatacggtaacgggtacgacgaacgggtacgtcgtacggtcggtttactaacggactcg

SEQ ID NO: 373739 - DNA, 546 bp, Homo sapiens
  misc_feature: GZ8MTXP02IDCJ2.22.82.H05.1.454.CMB.2.raw
  modified_base (350)..(350): a, c, t, g, unknown or other
  modified_base (363)..(363): a, c, t, g, unknown or other
  modified_base (384)..(384): a, c, t, g, unknown or other
  modified_base (400)..(400): a, c, t, g, unknown or other
  modified_base (411)..(411): a, c, t, g, unknown or other
  modified_base (415)..(415): a, c, t, g, unknown or other
  modified_base (419)..(419): a, c, t, g, unknown or other
  modified_base (425)..(425): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttgtggctattttaaaacgtgtccagtgtgaggtgcagctggcggagtcgtgggggaggcctggtacaggccgggggggtcctgagactctcctgtgtagcctccggattcacctttagcagacatggcatgagctgggtccgcaggctccgagggaggggccggagtgggtgtcagtcatgtagtagtgngatagattaccanacagactccgtgaaagggccncttcaccatctcaganactaactccanacanactntatcanacaatagtagtagacgtagagacgacgacgacgacgactacttacttactacgacgacgaagaacgtacgtacggtacgaacgaacggtacggtacgtacgtacgttacgtacgtacgtcg

SEQ ID NO: 373740 - DNA, 541 bp, Homo sapiens
  misc_feature: GZ8MTXP02GDXD2.22.82.H05.1.454.CMB.2.raw
  modified_base (372)..(372): a, c, t, g, unknown or other
  modified_base (480)..(480): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggcgttttctagtggctattttaaaacgtgtccagtgtgaggtgcagctggcggagtctgggggaggcctgggtacaggccgggggggtccctgagactctcctgtgtagcctccggattcacctttagcagacatggcatgagctgggtccgccaggctccgaggggaaggggccggagtggggtgtcagtcattagtagtagtggtgatagaatttaccanacagactccgtgaagggccgcttcaccatctctagagacaattcccagaacacactgtatctagacaaatgactaggctgagagccgacgacacggccatttattacngacgacgaagatacgtacgggtacgaacgaacggtcgacgtacggtcgtttacgagactcg

SEQ ID NO: 373741 - DNA, 569 bp, Homo sapiens
  misc_feature: GZ8MTXP02JA7VR.22.82.H05.1.454.CMB.2.raw
  modified_base (283)..(283): a, c, t, g, unknown or other
  modified_base (285)..(285): a, c, t, g, unknown or other
  modified_base (287)..(287): a, c, t, g, unknown or other
  modified_base (318)..(318): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgcgttttctaggtggctattttaaaacgtgtcagtgtgaggtgcagctggcggagtctgggggagcctggtacaggccgggggggtcctgagctctcctgtgtagcctccggattcacctttagcagacatggnangngcgtcggccgcgcgcgcgagggaggggcggnggtggtgtgtagtgtagtagtagtagtgtgagtagtatacacacacgctcgtacgacggccgctcactactactactagacgacactaccacaacacactacgtactactacgtactaaacgtacgtacgtacggtacgtagacgacgaccgacgacgaccgaccgtacttacttacgtacgacgacgaaggaacgtacgtacggtacggacgaacggtacggtacgtacgtacgttacgtacgtacgtcg

SEQ ID NO: 373742 - DNA, 574 bp, Homo sapiens
  misc_feature: GZ8MTXP02JWMM7.22.82.H05.1.454.CMB.2.raw
  modified_base (308)..(308): a, c, t, g, unknown or other
  modified_base (447)..(447): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctatttaaacgtgtcagtgtgaggtgcagctggcggagtcgtgggggaggcctggtacaggccgggggggtccctggagactctcctgtgtagcctccggattcacctttagcagacatggcatgagctgggtccgccgacggcnccgaggggaaggggccggaggtggggtggtcgagtcatagtagtagtggtgatagtaatttacacacagactccgtcggaagggccgcttcaccactctctagagacaacttacccacaacaacacctatacttactanacaatagagtagacgtagagacgacgacgacgacgactacttacttacgtacgacgacggaaggtaacgtacgtacggtacggaacgtaacggtacggtacgtacgtacgtttacgtacgtacgtcg

SEQ ID NO: 373743 - DNA, 608 bp, Homo sapiens
  misc_feature: GZ8MTXP02FM0D7.22.82.H05.1.454.CMB.2.raw
  modified_base (402)..(402): a, c, t, g, unknown or other
  modified_base (410)..(410): a, c, t, g, unknown or other
  modified_base (420)..(420): a, c, t, g, unknown or other
  modified_base (456)..(456): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctattttaaacgtgtccagtgtgaggtgcagctggcggagtcgtgggggaggcctggtacaggccgggggggtccctggagactctcctgtgtagcctccggatcaccttagcagacatggcatgagcgtggggtccgccaggctcccgaggggaaggggccggaggtggggtgtcgagtcattagagtagtggtgagtagaatttaccacacagactccgtaggaaaggggcccncttcaacntctctagganaacaaattcccaagaaccacaacttagttactctanacaaatacgtaacgtacggtacgtagaacgacggaccggaaccgaccgaccggaccgtactttaacttacgtacgtacgacggaaacggaacgtaacgtacgggtacggaacgaacggtacggtacgtacgtacgtttacgtacgtacgtcg

SEQ ID NO: 373744 - DNA, 684 bp, Homo sapiens
  misc_feature: GZ8MTXP02GB0XA.22.82.H05.1.454.CMB.2.raw
  modified_base (672)..(672): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggcctggtacaggccggggggtcctgagactctcctgtgtagcctccggattcacttagcagacatggcatgagcgtgggtcccgccaggcctccggaggggaacggggccggaggtggggtgtcgagtctagttaggtagtaggtggtagaagtaagtaaactttaccacaacgaagacctccggtaggaaacggggcccgtacctttaccaaccctattaccctacgttaaacggaacgtaaacctaaacttaccccgaaaacgaaacccaactaaccgttagtaaactaccgttacggaaacctaaaagttcgtaaacgtaacgggcgttaggaaacgacgggacccgaacgaaaccgaccggtaaccttatttaacttacgtcggacgacggaaaaggtactaacggttaccggggacaaacggaacgggtcggacctacggttccgtttanaacggacttccg

SEQ ID NO: 373745 - DNA, 554 bp, Homo sapiens
  misc_feature: GZ8MTXP02GD9G1.22.82.H05.1.454.CMB.2.raw
  modified_base (395)..(395): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccgggggggtccctgagactctcctgtgtagcctccggattcacctttagcagacatggcatgagctggggtccgccaggctccgaggggaaggggccggagtgggtgtcagtcattagtagtagtggtgatagaatttaccacacagactccgtaggaacgggccncttcaccatctctagacgacaattcccaagaacacactgtatctgacaaaatgactaggctagagacgccgacgacacggcctatttaactacgtgcgacgaaaggatacgtacggggtacaacgaacgggtcggacgttacgcgtttacaggtactcg

SEQ ID NO: 373746 - DNA, 569 bp, Homo sapiens
  misc_feature: GZ8MTXP02HJXW3.22.82.H05.1.454.CMB.2.raw
  modified_base (354)..(354): a, c, t, g, unknown or other
  modified_base (368)..(368): a, c, t, g, unknown or other
  modified_base (372)..(372): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctattttaaaacgtgtcagtgtgaggtgcagctggcggagtcgtgggggaggcctggtacaggccggggggtcctgagctctcctgtgtagcctcggattcacctttagcagacatggcatgagctgggcccgcaggctccgaggggaaggggccggaggtgggtgtcagtcattagtagtagtggtnatagaatttaccanacancgtccgtggaaacggccgcttcacctatctacagacacaattcccaagaccacactgtatctagacaaatagtagtagacgagagacgacggacgacgaccggacctattaattaacttagccggacgaaggaacgtagtacggttacggaacgaacggtacggacgtaacggtcgtttaccggttacgtattccgg

SEQ ID NO: 373747 - DNA, 556 bp, Homo sapiens
  misc_feature: GZ8MTXP02GGYWV.22.82.H05.1.454.CMB.2.raw
  modified_base (378)..(378): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttaggtggctaattttaaaacgtgtccagtgtgaggtgcagctggcggagtcgtgggggaggcctggtacaggccgggggggtccctgagactctcctgtgtagcctccggattcacctttagcagacatggcatgagcgtgggtccgccaggctccgaggggaaggggccggaggtgggtgtcgagtcattagtagtagtggtgatagaatttaccanacagactccgtggaacgggccgcttcaccatctctagagacaacttcccaagaaccacactgtatctagacaaatgaactaggctagagacgccgacgacacggctatttactactgcgacggaaaggatagtacggggtcaacgaacgggtcggacttacggtcgtttacagtatcg

SEQ ID NO: 373748 - DNA, 551 bp, Homo sapiens
  misc_feature: GZ8MTXP02JSH9P.22.82.H05.1.454.CMB.2.raw
  modified_base (395)..(395): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttgtggctattttaaaacgtgtccagtgtgaggtgcagctggcggagtcgtgggggaggcctggtacaggccgggggggtccctggagactctcctgtgtagcctcggattcacctttagcagacatggcatgagctggggtccgcaggctccgaggggaaggggccggaggtggggtgtcgagtcattagtagtagtggtgatagaatttaccacacagctccgtggaacgggccncttcgaccatctctagagacaattcccaagaacacactgtatctagacaaatgactaggctgagagccgacgacacggacctatttattacctgcgacgaaaggactacgtacggggtacaacgaacggtggactacggtcgtttaccagtactcg

SEQ ID NO: 373749 - DNA, 557 bp, Homo sapiens
  misc_feature: GZ8MTXP02HD6LM.22.82.H05.1.454.CMB.2.raw
  modified_base (358)..(358): a, c, t, g, unknown or other
  modified_base (495)..(495): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttggtggctaattttaaaacgtgtccagtgtgaggtgcagctggcggagtcgtgggggaggcctggtacaggccggggggtcctgagactctcctgtgtagcctccggattcaccttagcagacatggcatgagcgtgggtccgcgaggctccgaggggaacggggccggaggtgggtgtcagtcattagtagtagtggngatagtactttacacactacgactccgtaggaacgggccgtcttcaccagtctctaagagaacacttacccagaaccacatcgatctagactaaaatcgacagcgtagagacgccgagacgacgcctatttactacngacgacgaagactacgtacggacgaacgtaacggtcgaccgtacgtcgtttacgagtactcg

SEQ ID NO: 373750 - DNA, 565 bp, Homo sapiens
  misc_feature: GZ8MTXP02JF7NR.22.82.H05.1.454.CMB.2.raw
  modified_base (381)..(381): a, c, t, g, unknown or other
  modified_base (402)..(402): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggaggcctggtacaggccgggggggtccctggagactctcctgtgtagccctcggattcacctttagcagacatggcatgagcgtgggtcccgccgaggcctccgaggggaacggggccggaggtgggtgtcgagtcattagtagtagtggtgatagaatttaccanacagctccgtagaacgggccncttcaccatctactagagacattcccaagaaccacactgatctagacaaatgaactaggctagagacgaccgacgacgacggacctaatttactactgacgacgaaaggactaacgtacggggtcaacgaacggtcggactacggacgtttcctaagacttcg

SEQ ID NO: 373751 - DNA, 586 bp, Homo sapiens
  misc_feature: GZ8MTXP02FYE89.22.82.H05.1.454.CMB.2.raw
  modified_base (375)..(375): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccggggggtccctgagactctcctgtgtagcctccggattcacctttagcagacatggcatgagcgtgggtccgccaggctccgaggggaaggggccggaggtggggtgtcgagtctattagtagtagtggtgatagaatttaccanacagactccgtaggaacgggccgcttacgaccatcctctagagaacaacttaccccaagaaccacaactgtaatctagacaaatcgaactaggctagaacgcgaccgacgacacggacctatttacttacgtgaccgacgaaaggataacgtaaccgggtcgaaacgtaacggggtcgtaccgtaaccggtcgttttacgacggtattccg

SEQ ID NO: 373752 - DNA, 568 bp, Homo sapiens
  misc_feature: GZ8MTXP02IF9UU.22.82.H05.1.454.CMB.2.raw
  modified_base (382)..(382): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttatttaaaacgtgtccagtgtgaggtgcagcgtgggcgggaggtcgtgggggaggcctgggtacgaggccgggggggtccctggagactctcctgtgtagcctccggattcacctttagcagacatggcatgagctgggtccgccaggctccgaggggaaggggccggagtgggtgtcagtcattagagtagtggtgatagaatttaccactaacngaccgtccgtaggaaacggggcccgtccttcactatcctctagacgacaaacttcccaagaacacactgtactctagacaaatgactaaggctagagacgccgacgacgacggcctaatttactaactggccgtacgaaaggactacgtacgggtcacgaacggtgactacgcgtttcaggattcg

SEQ ID NO: 373753 - DNA, 558 bp, Homo sapiens
  misc_feature: GZ8MTXP02H9CJF.22.82.H05.1.454.CMB.2.raw
  modified_base (401)..(401): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccggggggtccctggagactctcctgtgtagcctccggattcacctttagcagacatggcatgagctgggtccgcaggctccgaggggaaggggccggagtgggtgtcagtcattagtagtagtggtgatagaatttaccacacagctccgtgaacgggccgcttcgacatcnctagagacaaacttcccaagaaccacactgtactctagacaaaagtgtaactagggctagacgagccgacgaacacggacctatttactactgaccgacgaaaggatacgtacggggtacaacgaacgggtcggactacgtcgtttactacggatcg

SEQ ID NO: 373754 - DNA, 575 bp, Homo sapiens
  misc_feature: GZ8MTXP02IPBOX.22.82.H05.1.454.CMB.2.raw
  modified_base (283)..(283): a, c, t, g, unknown or other
  modified_base (285)..(285): a, c, t, g, unknown or other
  modified_base (287)..(287): a, c, t, g, unknown or other
  modified_base (319)..(319): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggcgtttctagtggctatttaaaacgtgtccagtgtgaggtgcagctggcggagtctgggggaggcctggtacagccgggggggtccctgagactctcctgtgtagcctccggattcaccttagcagacatggnangngcgtcggtccgcgcgcgcgagggaggggcggnggtgggtgtgagtgtagttagtagtaggtggtagtatagtaacttacacacacgcgtcgtacggacgggccgtcctacacactctacgtagagactaactacccaacgaacaactactacgtatctacgactaaatacgtacgtaggtacgtagagacgacgacgacgacgtactacttacttacgtcgacgacggaagacgtacgtacggtacgacgaacggtacggtacgtacgtacgttacgtacgtacgtcg

SEQ ID NO: 373755 - DNA, 533 bp, Homo sapiens
  misc_feature: GZ8MTXP02GRDT2.22.82.H05.1.454.CMB.2.raw
  modified_base (371)..(371): a, c, t, g, unknown or other
  modified_base (390)..(390): a, c, t, g, unknown or other
  modified_base (404)..(404): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccgggggggtccctgagactctcctgtgtagcctccggattcacctttagcagacatggcatgagctgggtccgccaggctccgaggggaaggggccggaggtgggtgtcagtcattagtagtagtggtgatagaatttaccanacagctcgtgaagggccgntcacatctctaganacaattcccaagaacacactgatctagacaaatgactaggctagagagccgacgacgacggcctaatttactactgacgacgaaagactacgacgggtcaacgaacggtgactacgcgtttcagactcg

SEQ ID NO: 373756 - DNA, 560 bp, Homo sapiens
  misc_feature: GZ8MTXP02FTYE3.22.82.H05.1.454.CMB.2.raw
  modified_base (372)..(372): a, c, t, g, unknown or other
  modified_base (431)..(431): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctagtggctattttaaaacgtgtccagtgtgaggtgcagctggcggagtctgggggaggcctggtacaggccgggggggtccctgagactctcctgtgtagcctccggattcacctttagcagacatggcatgagctgggtccgccaggctccgaggggaaggggccggagtggggtgtcgagtcattagagtagtggtgatagaatttaccanacagactccgtgaaagggccgcttcaccatctctagagacaattcccagaaccacactntaatctagacaaatagacgtagacgagagagaccgacgacgacggaccattattaacttgcgacgaaggagtagttacggtacggacgaacggttacgggacgtacgtcgtttaccgttacggtattcg

SEQ ID NO: 373757 - DNA, 550 bp, Homo sapiens
  misc_feature: GZ8MTXP02IO7Y7.22.82.H05.1.454.CMB.2.raw
  modified_base (394)..(394): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttcttgtggctattttaaaacgtgtccagtgtgaggtgcagctggcggagtcgtgggggaggcctgggtacaggccgggggggtccctgagactctcctgtgtagcctccggattcacctttagcagacatggcatgagctgggtccgccaggctccgaggggaaggggccggagtggggtgtcgagtcagttagtagtagtggtgatagaatttaccacacagctccgtgaacggggccncttcaccatctctagacgaacaattcccaagtaaccacactagtatctgacaaatgactaggctagagacgccgacgacacggacctatttacttactgcgcgaagactacgtacggtcgaacgaacggtcggctacggtcgtttactagtactcg

SEQ ID NO: 373758 - DNA, 661 bp, Homo sapiens
  misc_feature: GZ8MTXP02GUK7K.22.82.H05.1.454.CMB.2.raw
  modified_base (372)..(372): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccgggggggtccctgagactctcctgtgtagcctccggattcacctttagcagacatggcatgagctgggtccgccaggctccgaggggaaggggccggaggtggggtgtcagtcattagtagtagtggtgatagaatttaccanacagctccgtgaacggggcccgcttcaccactctacgtaagacgaactaactacccaagaaccactacgtagtaactccgtagaacctaaagtcgaacgtaggtactaggaagaccggtacccggaacgaaaccggacccggtaccttaaattttaacgttaaccgtcgggacccgaaacgggaaaagggtaacttaaccggggttaaccgggtaccggaaaacggtaaaccgggggttcggaaccgttaaacccggttccggttttaaccgtacggtaatttccccgg

SEQ ID NO: 373759 - DNA, 579 bp, Homo sapiens
  misc_feature: GZ8MTXP02HRTX2.22.82.H05.1.454.CMB.2.raw
  modified_base (378)..(378): a, c, t, g, unknown or other
  modified_base (505)..(505): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccggggggtccctgagactctcctgtgtagcctccggattcaccttagcagacatggcatgagcgtgggtcccgccgaggcgtccgaggggaacggggccggaggtggggtgtcgagtcagttagtagtagtggtgatagaatttaccanacagactccgtgaacggccgcttcacctatctacagagacaacttcccagaaccacactgtatctagacaaaattcgaacttagggctagagacgaccggacgacgacggacctaatttacttacgngacgacgaaaggtactacgtaccgggtacgaacgtaacgggtcggtaccgttacgtcgtttacgaagtacgtcg

SEQ ID NO: 373760 - DNA, 571 bp, Homo sapiens
  misc_feature: GZ8MTXP02H2EPR.22.82.H05.1.454.CMB.2.raw
  modified_base (357)..(357): a, c, t, g, unknown or other
  modified_base (371)..(371): a, c, t, g, unknown or other
  modified_base (421)..(421): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctggtggctatttaaaacgtgtccagtgtgaggtgcagctggcggagtcgtgggggaggcctggtacgaggccgggggggtccctgagactctcctgtgtagcctccggattcacctttagcagacatggcatgagctgggtccgcaggctccgaggggaaggggccggagtgggtgtcagtcagttagtagtagtggngatagaattaccanacagctccgtagacgggccgcttcacatctctagagacaacttcccaaanaacactactgtactctagactaaatacgtacgtacgtacgtagagacgaccgacgacgaccgtactacttacttacgtacgacgacgaaggaacgtacgtacggtacgacgtaacggtacggtacgtacgtacgttacgtacgtacgtcg

SEQ ID NO: 373761 - DNA, 552 bp, Homo sapiens
  misc_feature: GZ8MTXP02I9RPB.22.82.H05.1.454.CMB.2.raw
  modified_base (409)..(409): a, c, t, g, unknown or other
  modified_base (467)..(467): a, c, t, g, unknown or other
  modified_base (479)..(479): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccggggggtccctggagactctcctgtgtagcctccggattcacctttagcagacatggcatgagctgggtccgccaggctccgaggggaaggggccggaggtgggtgtcgagtcagttagtagtagtggtgatagaatttaccacacagactccgtgaaagggcccgcttcaccatcctntaagacgacaacttccccaagaaccacactgtatctagacaaatgaacgtagctaganacgccgacgacncgacatttatactgccgagaaaggatacgtacggtcgaacgaaggttcggacttacgtcgtttacagtactcg

SEQ ID NO: 373762 - DNA, 564 bp, Homo sapiens
  misc_feature: GZ8MTXP02GY8J6.22.82.H05.1.454.CMB.2.raw
  modified_base (349)..(349): a, c, t, g, unknown or other
  modified_base (408)..(408): a, c, t, g, unknown or other
  modified_base (413)..(413): a, c, t, g, unknown or other
  modified_base (428)..(428): a, c, t, g, unknown or other
  modified_base (437)..(437): a, c, t, g, unknown or other
  modified_base (444)..(444): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctattttaaaacgtgtccagtgtgaggtgcagctggcggagtcgtgggggaggcctgggtacaggccgggggggtccctggagactctcctgtgtagcctcggattcacctttagcagacatggcatgagcgtgggtccgccaggctccgaggggaacggggccggagtggggtgtcgaggtnagttagtagtagtggtgatagtatttacacacagctccgtgaacggccgtcttcacctntctanagacactactccganacacacgtntatcganacaaatgacgagcgtagagacgacgacgacgacgacgtacttactacgtacgacgacgaggacgtacgtacggtacgaacgtaacggtacggtacgtacgtacgttacgtacgtacgtcg

SEQ ID NO: 373763 - DNA, 637 bp, Homo sapiens
  misc_feature: GZ8MTXP02JKEVZ.22.82.H05.1.454.CMB.2.raw
  modified_base (223)..(223): a, c, t, g, unknown or other
  modified_base (285)..(285): a, c, t, g, unknown or other
  modified_base (287)..(287): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgtctgagcgtgtcttttctagtggctaattttaaacgtgtccagtgtgagtgcagctggcggagtcgtgggggagcctggtacgnggccggggggtcctggagctctctgtgtacgcctcggattcaccttagcagacagtggcagngngcgtcggtccgcgacgcgacggacggggacggggcggaggtggtgtcgtagtagtagttagtaggtaggtggtagtagtaagtaacttaaccaacacgacgcgtaccgtacggacggaccgtctacacctactactacgtaacgaacgtactaactaccacgaacaacactagtactactacgacgtaacgtacgtacgtacgacgtagacgacgaccgaccgacgaccgtacctactttaacttacgtacggctaacggtaaacggtaacgtaacggtaaccgggtaaccggtaaaccggtaaccggtacggtaccggtaccggttaccgtttaccgttacgtacgtcg

SEQ ID NO: 373764 - DNA, 530 bp, Homo sapiens
  misc_feature: GZ8MTXP02FNNC5.22.82.H05.1.454.CMB.2.raw
  modified_base (387)..(387): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttcttgtggctattttaaaacgtgtccagtgtgaggtgcagctggcggagtctgggggaggcctggtacaggccgggggggtccctgagactctcctgtgtagcctccggattcacctttagcagacatggcatgagctgggtccgccaggctccgaggggaaggggccggagtggggtgtcagtcattagagtagtggtgatagaatttaccacacagctccgtgaaggggcncttcaccatctctagagacaattccccagaacacactgtatctgacaaatgactaggctgagagccgagacacggccatttatactgcgacgaaaggatacgtacggggtcgacaaacggtggactacggcgtttacagatcg

SEQ ID NO: 373765 - DNA, 587 bp, Homo sapiens
  misc_feature: GZ8MTXP02GZ3E1.22.82.H05.1.454.CMB.2.raw
  modified_base (522)..(522): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccgggggggtccctggagactctcctgtgtagcctcggattcacctttagcagacatggcatgagcgtggggtcccgccgaggcctccgaggggaacggggccggaggtgggtgtcgagtcattagtagtagtggtgatagaatttaccacacagactccgtagaacgggccgcttacaccatctctaagacgacaacttccccaagaaccacactgtaactcctagacaaaatcgaactagggctaggaacgacggcccgaacgaaccaccgggacctaagtttacttaacgnggaccgacggaaaggatacgtaacgggtcaacgaacgggtgacgtacgtcgtttacaggacttcg

SEQ ID NO: 373766 - DNA, 580 bp, Homo sapiens
  misc_feature: GZ8MTXP02JYQ3N.22.82.H05.1.454.CMB.2.raw
  modified_base (372)..(372): a, c, t, g, unknown or other
  modified_base (381)..(381): a, c, t, g, unknown or other
  modified_base (387)..(387): a, c, t, g, unknown or other
  modified_base (393)..(393): a, c, t, g, unknown or other
  modified_base (496)..(496): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttagtggctaattttaaaacgtgtccagtgtgaggtgcagctggcggagtcgtgggggaggcctggtacaggccggggggtccctgagactctcctgtgtagcctcggattcacctttagcagacatggcatgagctgggtccgcaggctccgaggggaaggggccggaggtgggtgtcgagtcagttagtagtagtggtgatagaattacanacagctcgngaggcnctcacntctctagagacattacccagaaccacactgtactctagactaaaagtcgaacttagggcttaggaagacggacccgaacgacgaacggcctatttaacttcgnggaccggcgtaaaagggactaaggtaccggggtacgaaccgtaaccggggttggaccgttacggtcgttttacgagaacttcgg

SEQ ID NO: 373767 - DNA, 592 bp, Homo sapiens
  misc_feature: GZ8MTXP02FRXWR.22.82.H05.1.454.CMB.2.raw
  modified_base (394)..(394): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccgggggggtccctgagactctcctgtgtagcctccggattcacctttagcagacatggcatgagctgggtccgccaggctccgaggggaaggggccggagtgggtgtcgagtcattagtagtagtggtgatagaatttaccacaacagctccgtgaaacgggcccncgttcaccatctctagagaacaattcccaagaaccacactgtactctagacaaatgaacttaggctagagacgacccgacgaacgaccggacctaagtttaacttacgtggaccgacggaaagggtataacgtaccggggtacgaaccgaaaccgggttggaaccgttacggtaccgttttaccgaaaggtctaccgg

SEQ ID NO: 373768 - DNA, 547 bp, Homo sapiens
  misc_feature: GZ8MTXP02FJ8HO.22.82.H05.1.454.CMB.2.raw
  modified_base (396)..(396): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttaggtggctattttaaaacgtgtccagtgtgaggtgcagctggcggagtcgtgggggaggcctggtacaggccggggggtccctgagactctcctgtgtagcctccggattcacctttagcagacatggcatgagctgggtccgccaggctccgaggggaaggggccggagtggggtgtcgagtcattagtagtagtggtgatagaatttaccacacagactccgtgaacgggccncttcaccatctctagagacaattcccaagaaccacactgtactctagacaaatagactagactgagagacgacgacgacggacctattattactgcgacgaaggatagtacggtacgacgaacggaggcgtacgtacgttcgttacgatcg

SEQ ID NO: 373769 - DNA, 569 bp, Homo sapiens
  misc_feature: GZ8MTXP02GO75D.22.82.H05.1.454.CMB.2.raw
  modified_base (369)..(369): a, c, t, g, unknown or other
  modified_base (392)..(392): a, c, t, g, unknown or other
  modified_base (405)..(405): a, c, t, g, unknown or other
  modified_base (411)..(411): a, c, t, g, unknown or other
  modified_base (423)..(423): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctattttaaaacgtgtccagtgtgaggtgcagctggcggagtcgtgggggagcctggtacaggccgggggggtccctgagactctcctgtgtagcctccggattcaccttagcagacatggcatgagctgggccgccaggctccgaggggaggggccggaggtgggtgtcagtcattagtagtagtggtgatagatttaccanacagactccgtagaacggggccncttcaccatcctntagaanactaactccaanacactactgtactctagactaatacgtacgtagacgtagagacgaccgacgacgacgactacttacttacgtacgacgacgaacggtacgtacgtacggtacggacgtaacggtacggtacgtacgtacgttacgtacgtacgtcg

SEQ ID NO: 373770 - DNA, 543 bp, Homo sapiens
  misc_feature: GZ8MTXP02I0457.22.82.H05.1.454.CMB.2.raw
  modified_base (339)..(339): a, c, t, g, unknown or other
  modified_base (367)..(367): a, c, t, g, unknown or other
  modified_base (389)..(389): a, c, t, g, unknown or other
  modified_base (403)..(403): a, c, t, g, unknown or other
  modified_base (407)..(407): a, c, t, g, unknown or other
  modified_base (431)..(431): a, c, t, g, unknown or other
  modified_base (433)..(433): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttgtggctattttaaaacgtgtccagtgtgaggtgcagctggcggagtcgtgggggaggcctggtacaggccgggggggtccctgagctctcctgtgtagcctccggattcaccttagcagacatggcatgagcgtgggccgcaggctccgaggggaaggggccggaggtgggtgtcagtnattagtagtagtggtgatagatttacanacagacttccgagaacgggccncttcaccatcctanaganacactacacacacactatatctananaatagagtagacgagagacgacgacgacgacgactattactactagacgacgaagacgtacgtacggtacgacgaacggtacgtacgtacgtacgtacgtacgtacgtcg

SEQ ID NO: 373771 - DNA, 586 bp, Homo sapiens
  misc_feature: GZ8MTXP02HJ11C.22.82.H05.1.454.CMB.2.raw
  modified_base (151)..(151): a, c, t, g, unknown or other
  modified_base (220)..(220): a, c, t, g, unknown or other
  modified_base (283)..(283): a, c, t, g, unknown or other
  modified_base (285)..(285): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgngtttctagtggctatttaaaacgtgtcagtgtgaggtgcagctggcggagtctgggggagcctggtacnggccgggggggtccctgagctctcctgtgtagcctccggattcacctttagcagacatggcangngcgtcggcgcgcgcgcgagggacggggcggaggtggtgtcgtagtgtagttagtagtaggtaggtagtagtagtaacttactacacacgtacgtacgtacggacggccgtacctacactactactactacgacgtaactaactaccacaacactactactactactacataatagtacgtagacgagacgacgacgacgacgacgtactacttactacgtacgacgacggtaacggtaacgtacggtacggtacggaacggtaacggtacggtacgtacgtacgttacgtacgtacgtacg

SEQ ID NO: 373772 - DNA, 600 bp, Homo sapiens
  misc_feature: GZ8MTXP02GP9XS.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttcttgtggctattttaaaacgtgtccagtgtgaggtgcagctggcggagtcgtgggggaggcctggtacgaggccgggggggtccctggagactctcctgtgtagcctccggattcacctttagcagacatggcatgagcgtgggtcccgccgaggcctccgaggggaaggggccggaggtggggtgtcgagtcattagtagtagtggtgatagtaatttaccacacagacctccgtaggaacgggccgcttcacctatcctctaagacgaacaacttcccaagaaccacacctgtatcgtagactaaatgaactagggctgaacgacgaccgacgaaccgacggtcctaatttactaacgtcgacggtacgaaaggacttaacgtaaccggggtacgaacgaaacggggtggaccgttaacggtccgtttacgaagtacttccgg

SEQ ID NO: 373773 - DNA, 585 bp, Homo sapiens
  misc_feature: GZ8MTXP02F9VFZ.22.82.H05.1.454.CMB.2.raw
tcagacatacgcgtcacgaccggtgctcgatttagtcgagctctctcgcggggtctgagagaggagcccagccctgggattttcaggttgttttcatttggtgatcaggactgaacagagagaactcaccatggagtttgggctgagcgtggtctttttcttgtggcttattttaaaacgtgtccagtgtgaggtgcagctggcggagtcgtgggggaggcctggtacgaggccggggggtccctgagactctcctgtgtagcctccggattcacttagcagacatggcatgagcgtgggtcccgccgaggccgtccgaggggaacggggccggaggtggggtgtcgagtctagttagtagtagtggtgatagtaatttaccacacagcctccgtaggaacgggccgtcttcacctatctactagagaactaacttccccaagaaaccactaactgtactctagacaaatcgaactagctagagagccgaacgacacggacctaatttacgtactgaccgacgaaaggatacgtacgggtacgaacgaacgggtcggacgtacggtaccgtttacgagtacgtcg

SEQ ID NO: 373774 - DNA, 585 bp, Homo sapiens
  misc_feature: GZ8MTXP02GCWMV.22.82.H05.1.454.CMB.2.raw
  modified_base (289)..(289): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggcgttttctaggtggctatttaaacgtgtccagtgtgaggtgcagctggcggagtcgtgggggagcctggtacaggccgggggggtccctgagactctcctgtgtagcctccggattcacctttagcagcatggcatgngcgtcggtccgcgcggcgccggacggggacggggacggaggtgggtgtcgagtagtagtagtagtaggtggtagtagtagtaattactacacacgcgtacgtacggacggccgtacctacacctactctacgtagacgaactactaccaacaacaacactactactactacgacaaatagtacgtagacgtagagacgacgacgacgacgacgtacttatacgtacgacgacgaagtaacgtacgtacggtacgaacgaacggtacggtacgtacgtacgttacgtacgtacgtcg

SEQ ID NO: 373775 - DNA, 558 bp, Homo sapiens
  misc_feature: GZ8MTXP02GDWLD.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttgtggctattttaaaacgtgtccagtgtgaggtgcagctggcggagtctgggggaggcctggtacaggccgggggggtccctgagactctcctgtgtagcctcggattcacctttagcagacatggcatgagctgggtccgccaggctccgaggggaaggggccggagtgggtgtcgagtcattagagtagtggtgatagaatttaccgacacagactccgtggaaacgggccgcttcaccatcctctagagacaattccccaagaaccacactagtactctagacaaaatgaactagggctagagacgaccgacgacacggacctatttacttactggaccgcgaaaggatacgtacggggtcaacgaacgggtcgactacggtcgtttcaggactcg

SEQ ID NO: 373776 - DNA, 581 bp, Homo sapiens
  misc_feature: GZ8MTXP02F85XU.22.82.H05.1.454.CMB.2.raw
  modified_base (423)..(423): a, c, t, g, unknown or other
  modified_base (525)..(525): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggagcctggtacaggccggggggtcctgagactctcctgtgtagcctccggattcacctttagcagacatggcatgagcgtgggtcccgccgaggcctccgaggggaaggggccggaggtggggtgtcaggtcagttagtagtagtggtgatagtaatttaccatacagactccgtaggaaacggggccgcttacacctatcctctaagganaacctaacttcccccaaagaaccactaacttgtaactctgacaaatgactagggctagagagccgacacgacggacctagtttatacgtgcgacgaaaggtntacgtaacggggcaacgaacggggttcgacgttacggtcgttttacaggattccgg

SEQ ID NO: 373777 - DNA, 560 bp, Homo sapiens
  misc_feature: GZ8MTXP02GZL7H.22.82.H05.1.454.CMB.2.raw
  modified_base (283)..(283): a, c, t, g, unknown or other
  modified_base (285)..(285): a, c, t, g, unknown or other
  modified_base (287)..(287): a, c, t, g, unknown or other
  modified_base (300)..(300): a, c, t, g, unknown or other
  modified_base (333)..(333): a, c, t, g, unknown or other
  modified_base (445)..(445): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctattttaaacgtgtcagtgtgaggtgcagctggcggagtcgtgggggaggcccggtacaggccgggggggtccctgagctctcctgtgtagcctccggattcactttagcagacatggnangngcgtcggtcgcgngcgcgacgggacgggcggaggtggtgtcgagtntagtagtagtagtggtagtagtagtacttacacacacgacgtcgtacgacggccgtctcactactctactacgacgaactaactaccaacgaacacactagtactactacanaatagtacgtagacgagagacgacgacgacgacgactattatactacgcgacgaacgtagtacgtacggtacgacgacggtaacgtacgtacgtacgtacgtacgtacgtcgtcg

SEQ ID NO: 373778 - DNA, 572 bp, Homo sapiens
  misc_feature: GZ8MTXP02JT09W.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccgggggggtccctggagactctcctgtgtagcctccggattcacctttagcagacatggcatgagctggggtccgccaggcctccgaggggaacggggccggaggtgggtgtcagtcattagtagtagtggtgatagaatttaccacacagacctccgtaggaaacggggcccgtactttaccattcctactaggagtaacaacttccccaagaacacactgtatctagacaaatgactaggctagagacgccgacgacacggcctaatttactactcggacgacgaaaggatacgtaccgggtacaacgaacggtcgacttacggcgtttagagactcgtacc

SEQ ID NO: 373779 - DNA, 643 bp, Homo sapiens
  misc_feature: GZ8MTXP02HEG6N.22.82.H05.1.454.CMB.2.raw
  modified_base (291)..(291): a, c, t, g, unknown or other
  modified_base (293)..(293): a, c, t, g, unknown or other
tcagacatacgcgtcacgaccggtgctcgatttagtcgagctctctcgcggggtctgagagaggagcccagccctgggattttcaggtgttttcatttggtgatcaggactgaacaggagaggaactacgaccataggagtttgggctgagctggctttttcttgtggctattttaaaacgtgtccagtgtgaggtgcagctggcggagtctgggggagcctggtacaggccgggggggtccctggagactctcctgtgtagcctccggattcacctttagcagacatggnangagcgtcggccgcgcgcgcgaggacgggcggaggtggtgtcgagtagtagtagtagtagtggtagtagtagtaacttactacacacgacgtacgtacggacggaccgtccgtactacctactactactagacgaactaactacccaacgaacaacactacgtactactacgtaactaaacgtacgtacgtacgtacgtagacgacgaccgaaccgaaccgaccggtaccgtaacgtttaacttaacgtacggtacggaacggtaaacggtaacgtaacggtaacgggtaacggtaaccggtaaccggtacggtaccggttaccggttaccgtttacgttacgtacgtacg

SEQ ID NO: 373780 - DNA, 581 bp, Homo sapiens
  misc_feature: GZ8MTXP02HXZCG.22.82.H05.1.454.CMB.2.raw
  modified_base (277)..(277): a, c, t, g, unknown or other
  modified_base (281)..(281): a, c, t, g, unknown or other
  modified_base (283)..(283): a, c, t, g, unknown or other
  modified_base (285)..(285): a, c, t, g, unknown or other
  modified_base (315)..(315): a, c, t, g, unknown or other
  modified_base (325)..(325): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctattttaaaacgtgtcagtgtgaggtgcagctggcggagtctgggggagcctggtacaggccggggggtcctgagactcgtctgtgtagcctcggattcacctttagcagacngtgnangngcgtcggccgcgcgcgcgaggacgggcggnggtggtgtgngtacgtagtagtaggtagtggtagtagtaagtaacttacacacgacgtacgtacgtacggacggaccgtcctacacctactactacgtagacgaactaactaccaacgaacaactactacgtactactataactaatacgtacgtagacgagacgacgacgacgacgacgtacgtattactacgtacgcgacgaagtaacgtacgtacggtacgacggaacggtacggtacgtacgtacgttacgtacgtacgtcg

SEQ ID NO: 373781 - DNA, 650 bp, Homo sapiens
  misc_feature: GZ8MTXP02GMF2P.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcggtgtgtttctaggtggctattttaaaacggtgtccagtgtgaggtgcagctggcggagtctgggggaggcctggtacaggccgggggggtccctgagctctcctgtgtagcctccggattcacctttagcagcatggcatgagcgtgggtccgccaggcgtcccgaggggaaggggccggggaggtgggtggtgtagtcgtagttagtagtaggtggtagtagtagtaacttacacacacgacgtaccgtacggacgggaccgtcctactacctactactacgtagacgaactaactacccgaacgaacaactactacgtactactacgactaaacgtacgtacgtacggtacgtaggacggacggaccggaaccggaaccgaccgtaccgtactttaacgttacgtacggtacggacggtaaaggtaacgtaacgtacgggtaccggtaacggtaacgggtacgggtaccgttacggttacggtttacgttacgtacgtcg

SEQ ID NO: 373782 - DNA, 602 bp, Homo sapiens
  misc_feature: GZ8MTXP02H48NS.22.82.H05.1.454.CMB.2.raw
  modified_base (375)..(375): a, c, t, g, unknown or other
  modified_base (385)..(385): a, c, t, g, unknown or other
  modified_base (398)..(398): a, c, t, g, unknown or other
  modified_base (408)..(408): a, c, t, g, unknown or other
  modified_base (447)..(447): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttagtggctaattttaaaacgtgtccagtgtgaggtgcagctggcggagtcgtgggggagcctggtacaggccgggggggtcctgagactctcctgtgtagcctcggattcaccttagcagacatggcatgagctgggccgccaggctccgaggggaaggggccggaggtggggtgtcgaggtcaattagtagtagtggtgatagtaatttaccanacagactcgngaaaggccgcttnaccatcctanagacactaactcccaagaaccactactcgtactacgtanacaaactagtaacgtaggacgtagagacgaccgaaccgaaccgaaccgacctaacttaacttacgtacgacgaacggaaacggtaaacgtaacgtaacggtaaccggaacggaacggtacggtacgtacggttacggtttacgtacgtacgtacg

SEQ ID NO: 373783 - DNA, 541 bp, Homo sapiens
  misc_feature: GZ8MTXP02JREVU.22.82.H05.1.454.CMB.2.raw
  modified_base (236)..(236): a, c, t, g, unknown or other
  modified_base (368)..(368): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccgggggtntccctgagactctcctgtgtagcctcggattcaccttagcagacatggcatgagctgggtccgccaggctccgaggggaaggggccgaggtgggtgtcagtcagttagtagtagtggtgatagaattaccanacagactcgtgaagggccgctcaccatctactagagacaattcccaagaacacacgtgtatactgacaaatgactagctgagcgccgacacgacgctatttactactggacgacggaaaggataacgtacgggtacgaacgacgggtacggcgtacggtcgtttacgagtacg

SEQ ID NO: 373784 - DNA, 652 bp, Homo sapiens
  misc_feature: GZ8MTXP02G2TZ2.22.82.H05.1.454.CMB.2.raw
  modified_base (295)..(295): a, c, t, g, unknown or other
  modified_base (334)..(334): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctattttaaaacgtgtcagtgtgaggtgcagctggcggagtcgtgggggagcctggtacaggccggggggtcctgagctctctgtgtagcctcggatcaccttagcagacatggcatgagcgtggccgcnggcgccgaggggaaggggccggtagtgggtgtcaggttntagttagtagtaggtgtagtatacgtaacttaccacacgacgtccgtacgaggacggcctactacacctactactagtagacaactaactacccgaaagaaccacgtacgttagtactacgtagtacgtaaacgtacgtaacgtacggtacgtagacgacggaccggaaccgaccggtaaccggtaaccgttaacgtttaacgttacgtacggtaccggtaacggtaaacggtaacggtaacggttaaccgggtaaccggtaaccggtaacgggtacggtaccggttaccggttaccgtttacgttacggtacgtacg

SEQ ID NO: 373785 - DNA, 573 bp, Homo sapiens
  misc_feature: GZ8MTXP02HPA2O.22.82.H05.1.454.CMB.2.raw
  modified_base (346)..(346): a, c, t, g, unknown or other
  modified_base (362)..(362): a, c, t, g, unknown or other
  modified_base (379)..(379): a, c, t, g, unknown or other
  modified_base (398)..(398): a, c, t, g, unknown or other
  modified_base (413)..(413): a, c, t, g, unknown or other
  modified_base (425)..(425): a, c, t, g, unknown or other
  modified_base (436)..(436): a, c, t, g, unknown or other
  modified_base (441)..(441): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctattttaaaacgtgtcagtgtgaggtgcagctggcggagtcgtgggggaggcctggtacgaggcccgggggggtcctgagctctcctgtgtagcctccggattcacctttagcagacatggcatgagctgggtcccgccaggcctccgaggggaacggggccggaggtgggtgtcgagtnagttagtagtagtggngtatagtaatttaccanacagcctcgtgaagggccnctcacctatctcagnaacattcccaanaacacacgttnatctnaataatgatggacagacgcgacgacgaccgacgtactagttactacgtacgacggaacggtaaggtaacgtacggtacgggtaccgaacggtaacggtcggaacctttacggtacgtttacgtacgtcgtcg

SEQ ID NO: 373786 - DNA, 653 bp, Homo sapiens
  misc_feature: GZ8MTXP02GY96M.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttggtggcttaattttaaaacgtgtccagtgtgaggtgcagctggcggagtcgtgggggagcctggtacgaggccggggggtcctgagactctcctgtgtagcctcggattcaccttagcagacatggcatgagcgtgggtcccgccgacggctccgaggggaacggggccggaggtgggtgcaggtctagttagtagtagtggtagataagtaaactttaccaacacagaccgtcgtagaacggggcctacttcaacctatcctactaagaacgaactaaacttccccaaagaaacccactaaccttagtaactcgtaacgactaaaagtcgtaacttaagggctaggaaacgacggaccgaacgtaaccgaccggtacctaaagtttaactttacgacggacggacggtaaaaggtactaaacgggttaaccggggtcgaaaacggtaacggggtcgtaccgtaacggttcgtttaccgaagtacgttcccg

SEQ ID NO: 373787 - DNA, 557 bp, Homo sapiens
  misc_feature: GZ8MTXP02J16YU.22.82.H05.1.454.CMB.2.raw
  modified_base (421)..(421): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggcgttttctagtggctattttaaaacgtgtccagtgtgaggtgcagctggcggagtctggggggaggcctgggtaccaggccggggggggtccctggagactctcctgtgtagcccttccggattcacctttagcagacatggcatgagctgggccgccaggctccgaggggaaggggccggagtggggtgtcaggtcattagtagtagtggtgatagaatttaccacacagctccgtgaaggcgcttcaccatctcaggacacactccanaacacactgtatctagacaatagacgtagacgagagacgacgacgacgacgactacttacttacgtacgacgacgaagacgtacgtacggtacgacgtaacggtacggtacgtacgtacgttacgtacgtacgtcg

SEQ ID NO: 373788 - DNA, 554 bp, Homo sapiens
  misc_feature: GZ8MTXP02F82S4.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggctattttaaaacgtgtccagtgtgaggtgcagctggcggagtcgtgggggaggcctggtacaggccgggggggtccctgagactctcctgtgtagcctcggattcacctttagcagacatggcatgagcgtgggtccgccgaggctccgaggggaaggggccggagtgggtgtcagtcattagtagtagtggtgatagaatttaccacacagctccgtgaacgggccgtcttcaccatctctagagacaattcccaagtaacacactgtaatctagacaaatgactaggctagacgagccgacgacacggacctatttatcgtgacgacgaagtataacgtacgggacgaccgaaacgggtcggaccttacgcgtttaccagacttccg

SEQ ID NO: 373789 - DNA, 567 bp, Homo sapiens
  misc_feature: GZ8MTXP02GZU0R.22.82.H05.1.454.CMB.2.raw
  modified_base (151)..(151): a, c, t, g, unknown or other
  modified_base (174)..(174): a, c, t, g, unknown or other
  modified_base (219)..(219): a, c, t, g, unknown or other
  modified_base (247)..(247): a, c, t, g, unknown or other
  modified_base (271)..(271): a, c, t, g, unknown or other
  modified_base (274)..(274): a, c, t, g, unknown or other
  modified_base (276)..(276): a, c, t, g, unknown or other
  modified_base (278)..(278): a, c, t, g, unknown or other
  modified_base (308)..(308): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgngtttctagtggctatttaaacgngtcagtgtgaggtgcagctggcggagtctgggggagcctggtacngccggggggtccctgagctctctgtgtncctcggattcacctttagcagacntgnangngcgtcggccgcgcgcgcgaggacgggcggnggtggtgtcgtagtacgtagtagtagtagtggtagtagtagtacttacacacgacgcgtacgtacgacggcgtctcactactactactagacgacactacacgacacactatactcgtacgactaagtacgtacgtagtacgtacgacgacgacgacgacgacgtacgtacgttacgttacgtacgacgacgaacggtaacgtacgtacggtacggtacgtaacggtacggtacgtacgtacgttacgtacgtacgtcg

SEQ ID NO: 373790 - DNA, 573 bp, Homo sapiens
  misc_feature: GZ8MTXP02HJSUH.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctgatacgaggccggggggtccctgagactctcctgtgtagcctccggattcacctttagcagacatggcatgagctgggtccgccaggcctccgaggggaaggggccggaggtgggtgtcgagtcagttagtagtagtggtgatagtaactttacacacagtactcggtaggaacggggcctcgttccacccattcctactagacgactaaacttcccaagtaaaccactactgtatctagacaaatcgactagggctgagacgaccgacgacacggctatttaactactgcgacgtaaggactacgtacgggtacgaacgtaacgggtcgacgtacggtccgtttactagtacg

SEQ ID NO: 373791 - DNA, 550 bp, Homo sapiens
  misc_feature: GZ8MTXP02J0XIT.22.82.H05.1.454.CMB.2.raw
  modified_base (357)..(357): a, c, t, g, unknown or other
  modified_base (373)..(373): a, c, t, g, unknown or other
  modified_base (391)..(391): a, c, t, g, unknown or other
  modified_base (399)..(399): a, c, t, g, unknown or other
  modified_base (403)..(403): a, c, t, g, unknown or other
  modified_base (417)..(417): a, c, t, g, unknown or other
  modified_base (426)..(426): a, c, t, g, unknown or other
  modified_base (433)..(433): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctaggtggctatttaaacgtgtcagtgtgaggtgcagctggcggagtcgtgggggacggcctgggtacaggccgggggggtccctgagactctcctgtgtagcctccggattcacctttagcagacatggcatgagctgggtccgcaggctccgaggggaggggccggtagtgggtgtcagtcagttagtagtagtggtanagtagtaatttaccanacagctcgtagacgggcnctcacctntctnagacacactaccanacactactntactcanacaatagagtagagagagacgacgacgacgaccgtactacttactacgtacgacgacgaagtacgtacgtacggtacgacgaacggtcggtacgtacgtacgttcgtacgtacgtcg

SEQ ID NO: 373792 - DNA, 538 bp, Homo sapiens
  misc_feature: GZ8MTXP02JLY0Y.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacgaggccggggggtccctggagactctcctgtgtagcctccggattcacctttagcagacatggcatgagctgggtccgccaggctccgaggggaaggggccggagtggggtgtcagtcattagtagtagtggtgatagaatttaccactacagctccgtgaagggccgcttcacatctctagagacattcccaagaaccacactgatctagcaaatgactaggctagacgagaccgacgacacggctattacttactgcgacgaacggatacgtacgggtacgacgaacggtgactacgcgtttacacggatcg

SEQ ID NO: 373793 - DNA, 596 bp, Homo sapiens
  misc_feature: GZ8MTXP02G7S1P.22.82.H05.1.454.CMB.2.raw
  modified_base (151)..(151): a, c, t, g, unknown or other
  modified_base (277)..(277): a, c, t, g, unknown or other
  modified_base (279)..(279): a, c, t, g, unknown or other
  modified_base (281)..(281): a, c, t, g, unknown or other
  modified_base (283)..(283): a, c, t, g, unknown or other
  modified_base (285)..(285): a, c, t, g, unknown or other
  modified_base (313)..(313): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgngttttctagtggctattttaaaacgtgtcagtgtgaggtgcagctggcggagtcgtgggggagcctggtacaggccggggggtcctgagctctcctgtgtagcctccggattcacctttagcaganangnangngcgtcgcgcgcgcgcgaggagggacggnggtggtgtcgagtgtagtagtagtagtgtagtagtagtaactacacacgacgtacgtacgtacggacggaccgtaccgtacacctactactactagaacgaactaactacccgaacgaaccaactaactacgtacgtactacgtaacaaatacgtacgtacgtacgagacgacgacgaacgacgacgtacgtacttacgttacgtacgacgacggaaggtaacgtacgtacggtacgaaccggtaacggtacggtacgtacgtacgttacgtacgtacgtacg

SEQ ID NO: 373794 - DNA, 604 bp, Homo sapiens
  misc_feature: GZ8MTXP02JNI1Y.22.82.H05.1.454.CMB.2.raw
  modified_base (281)..(281): a, c, t, g, unknown or other
  modified_base (288)..(288): a, c, t, g, unknown or other
  modified_base (290)..(290): a, c, t, g, unknown or other
  modified_base (322)..(322): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctaattttaaaacgtgtccagtgtgaggtgcagctggcggagtcgtgggggagccgtggtacaggccggggggtcctggagctctcctgtgtagcctcggattcacctttagcagnatgcagngngcgtcggcgcgcgcgtcggacggacgggcggnggtggtgtcgtagtacgtagttagtagtagtggtagtagtagtaacttactacacgacgtcgtacgtacggacggaccgtactactactactactacgtacgacgactactaccacgaacactactacgtactactacgtactaagtacgtacgtacgtacgtagacgacgacgacgacgaccgtacgtacttacgttacgtacgacgacggtaacggtaacgtacgtacggtacggtaacggtaacggtacggtacgtacgtacgttacgtacgtacgtcg

SEQ ID NO: 373795 - DNA, 563 bp, Homo sapiens
  misc_feature: GZ8MTXP02HR5P8.22.82.H05.1.454.CMB.2.raw
  modified_base (284)..(286): a, c, t, g, unknown or other
  modified_base (288)..(288): a, c, t, g, unknown or other
  modified_base (324)..(324): a, c, t, g, unknown or other
  modified_base (328)..(328): a, c, t, g, unknown or other
  modified_base (453)..(453): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctattttaaaacgtgtcagtgtgaggtgcagctggcggagtctgggggaggcctggtacaggccggggggtccctgagactctcctgtgtagcctcggattcacctttagcagacatgnnngngcgcggcgcgcgcgcgaggagggcggaggtggtgtnagtntagtagtagtagtggtagtagtaagtaactaacacaacacgtacgtaccgtacggaacggaccgtacctacaccactactacgagacgaactaactacccaacgaaacaacactactactactanactaaatagtagtagacgagagacgacgacgacgacgactactatactacgacgacgaagagtacgtacggtacgacgaacgacgacgtacgtacgtacgtacgtacgcg

SEQ ID NO: 373796 - DNA, 563 bp, Homo sapiens
  misc_feature: GZ8MTXP02IORGY.22.82.H05.1.454.CMB.2.raw
  modified_base (178)..(178): a, c, t, g, unknown or other
  modified_base (263)..(263): a, c, t, g, unknown or other
  modified_base (266)..(266): a, c, t, g, unknown or other
  modified_base (273)..(273): a, c, t, g, unknown or other
  modified_base (275)..(275): a, c, t, g, unknown or other
  modified_base (277)..(277): a, c, t, g, unknown or other
  modified_base (279)..(279): a, c, t, g, unknown or other
  modified_base (281)..(281): a, c, t, g, unknown or other
  modified_base (283)..(283): a, c, t, g, unknown or other
  modified_base (285)..(285): a, c, t, g, unknown or other
  modified_base (315)..(315): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcggtgtgtttctaggtggctattttaaaacgngtcagtgtgaggtgcagctggcggagtctgggggaggcctggtacgagccggggggtcccgtgagactctcctgtgtgctccggntcnccttagnananangnangngcgtcggcgcgcgcgcgagggacgggcggnggtggtgtgagtcgtagtagtagtaggtggtagtagtagtacttacacacacgcgtacgtacggacggccgtcctacactactctactagacgaactaactacccaacaacacactagtactactagataatacgtacgtagtacgtagagacgacgacgacgacgactacttacttactcgcgacgaagtacgtacgtacggtacgacgtaacggtacggtacgtacgtacgttacgtacgtagtcg

SEQ ID NO: 373797 - DNA, 601 bp, Homo sapiens
  misc_feature: GZ8MTXP02H37DQ.22.82.H05.1.454.CMB.2.raw
tcagacatacgcgtcacgaccggtgctcgatttagtcgagctctctcgcgggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggcctggtacgaggccggggggtccctgagactctcctgtgtagcctccggattcaccttagcagacatggcatgagcgtgggtcccgccgaggcctccggaggggaacggggccggaggtggggtgtcgaggtcattagtaggtaggtggttagataagaatttaccagcacgctccggtagaacgggcccgtcttccgacctatccctcagacgacaaactccccaaagaaccacactgtactcgtgactaaaatcgaactaggctaggagacgccgaacgaccacggacctaagtttacttaacgcgtcggaacgaaaggtactacgtaccggggtacgaacgaacgggtcggaccttaacggtccgtttacgaagtacgtcg

SEQ ID NO: 373798 - DNA, 608 bp, Homo sapiens
  misc_feature: GZ8MTXP02FX0EN.22.82.H05.1.454.CMB.2.raw
  modified_base (394)..(394): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaaacgtgtccagtgtgaggtgcagctggcggagtcgtgggggaggcctggtacaggccggggggtccctgagactctcctgtgtagcctccggattcacctttagcagacatggcatgagctgggtccgccaggcctccgaggggaaggggccggagtggggtgtcagtcagttagtagtagtggtgatagaatttacacacagactccgtaggaacgggccncttacaccatctctagagaacaattcccaagaaccacactgtatctagactaaaagtgaactaggctagacgacggccgacgaacgacggacctaattttactaaccgtgaccggacgaaaaggggtacttaacggttaaccggggtcgtaaaccggaaacggggtttcggaaccgttaacccggttccggttttaacgtaacggtacgtccgg

SEQ ID NO: 373799 - DNA, 588 bp, Homo sapiens
  misc_feature: GZ8MTXP02JOGZG.22.82.H05.1.454.CMB.2.raw
  modified_base (300)..(300): a, c, t, g, unknown or other
  modified_base (343)..(343): a, c, t, g, unknown or other
  modified_base (359)..(359): a, c, t, g, unknown or other
  modified_base (374)..(374): a, c, t, g, unknown or other
  modified_base (407)..(407): a, c, t, g, unknown or other
  modified_base (417)..(417): a, c, t, g, unknown or other
  modified_base (429)..(429): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctattttaaaacgtgtcagtgtgaggtgcagctggcggagtcgtgggggaggcctggtacaggccgggggggtccctgagactctcctgtgtagcctccggattcaccttagcagacatggcatgagctgggccnccaggctccgaggggaacggggccggaggtggggtgtcgagtnattagtagtaggtggngatagtaattaccanacagactccgtagaacgggccgtcttcaacctntctagtaganactactaccaanaaccactactagtactcgtagactaagtagtacgtagtacgtacgagacgaccgacgacgaccgactacttacgttacgtacgacgacgaacggtaacgtacgtacggtaacggaacggtaacggtacggtacgtacggtacgttacgtacgtacgtcg

SEQ ID NO: 373800 - DNA, 570 bp, Homo sapiens
  misc_feature: GZ8MTXP02JQHGO.22.82.H05.1.454.CMB.2.raw
  modified_base (376)..(376): a, c, t, g, unknown or other
  modified_base (379)..(379): a, c, t, g, unknown or other
  modified_base (398)..(398): a, c, t, g, unknown or other
  modified_base (428)..(428): a, c, t, g, unknown or other
  modified_base (436)..(436): a, c, t, g, unknown or other
  modified_base (440)..(440): a, c, t, g, unknown or other
  modified_base (442)..(442): a, c, t, g, unknown or other
  modified_base (444)..(444): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctattttaaaacgtgtcagtgtgaggtgcagctggcggagtcgtgggggaggcctggtacagggccgggggggtcctggagactctcctgtgtagcctcggattcacctttagcagacatggcatgagcgtgggccgccgaggcctccgaggggaaggggccgggagtggggtgtcgagtcattagtagtagtggtgatagaattaccanacngactccgtagaacgggccncttacacatctcagacacaaattcccaaanaacacatntacnananaatagagagcgagagacgacgacgacgacgactacttacttacgtcgacgacggaaacggtaacgtacggtacgggtaacggaacgtaacggtacggtacgtacgtacggttacgtacgtacgtcg

SEQ ID NO: 373801 - DNA, 549 bp, Homo sapiens
  misc_feature: GZ8MTXP02F74UZ.22.82.H05.1.454.CMB.2.raw
  modified_base (379)..(379): a, c, t, g, unknown or other
  modified_base (491)..(491): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttagtggctattttaaaacgtgtccagtgtgaggtgcagctggcggagtcgtgggggaggccgtggtacaggccgggggggtccctgagactctcctgtgtagcctccggattcacctttagcagacatggcatgagcgtgggtccgccaggctccgaggggaaggggccggaggtgggtgtcaggtctagttagtagtagtggtgatagaatttaccanacagctcgtgaaggccgcttacaccatctctagagaacaacttcccagaacacactgatcagacaaatgactagggctagacgagcgacgacacggacctatttatacctgngcgaagtagtacgtacggtacgacgaacggtacggacgtacgtcgttactacgagtcg

SEQ ID NO: 373802 - DNA, 646 bp, Homo sapiens
  misc_feature: GZ8MTXP02IB5YE.22.82.H05.1.454.CMB.2.raw
  modified_base (310)..(310): a, c, t, g, unknown or other
tcagacatacgcgtcacgaccggtgctcgatttagtcgagctctctcgcgggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggagcctggtacaggccgggggtcggtcctgacgtctctcgtgtgcgccgtcgtatacctacttgacagactagtcgctagtagcgtcggtccggccncgaggtcctacgggaagggggaaccggggcggtagggttcgggtcgtacgtacgtacttaagttaggtagttaggtggtagtataagttaacttacacacacgtacctcggaggaccgtcccgtactaccactactcacgtaagacgaacttacctaccgaaacgaacctactacgttatactacgtacgaaactaagtcgaacgggtacgtacgaggaacggaccgaacccggaacgaccggtaaccgtactttaaatttacgtacgtcggcgtaaacggagtactacggtacggtaccgaaggtacggtcgtaccgtacggtctttagaacgtc

SEQ ID NO: 373803 - DNA, 695 bp, Homo sapiens
  misc_feature: GZ8MTXP02HPYWI.22.82.H05.1.454.CMB.2.raw
  modified_base (331)..(331): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttctgtggctattttaaaacgtgtccagtgtgaggtgcagctggcggagtcgtgggggagcctggtacaggccggggggtcctggagactcgtcctgtgtacgcctcggattcactttagcagacatggcatgagcgtgggtccgcaggcctcgaaggggagggcccggaggtgggtntacgagtacgtagttagtacgtaggtggtacgagtagtaactttaccgaacgtacgaacggtccgttaccggtaggaaacgggtcccgtacttaccgaacccgtagttcccgttacgtaaaggtaccgtaacctaaccgttccccgaaaggtaacccaaccgtacttacggtaacttacgtagtacccgtaaaagttcggtaaccttaggggtacccttaggaacgaccggtaccgaacggtaccgtaccggtcctaaagttttactacgtggtaccggaacgtaaaggtactaacgggtaccggggttacaaccgggtaaacggtcgaccgttacggtacgtttaccgtacggtacttccggg

SEQ ID NO: 373804 - DNA, 570 bp, Homo sapiens
  misc_feature: GZ8MTXP02J0JDF.22.82.H05.1.454.CMB.2.raw
  modified_base (373)..(373): a, c, t, g, unknown or other
  modified_base (402)..(402): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccgggggggtccctggagactctcctgtgtagcctccggattcacctttagcagacatggcatgagctgggtccgccaggctccgaggggaaggggccggaggtggggtgtcagtcattagtagtagtggtgatagaatttaccanactagactcgtgaacgggccgcttcaccntctctagagacaacttcccagaaaccacaactgtactctagacaaatgactaaggctagacgagacccgacgaccacgggacctaagtttactacgtagcgacggaaaggactacgtacggggtacgaacgtaacgggtcggacgtacggtacgtttcaggacttcgg

SEQ ID NO: 373805 - DNA, 611 bp, Homo sapiens
  misc_feature: GZ8MTXP02HBYPY.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttgtggctattttaaaacgtgtccagtgtgaggtgcagctggcggagtcgtgggggaggccgtggtacgaggccgggggggtccctggagactctcctgtgtagcctccggattcacctttagcagacatggcatgagcgtgggtcccgccgaggcctcccgaggggaacggggccggaggtgggtgtcgagtcagttagtagtagtggtagatagtaactttaccactacagtctccgtaggaacgggtccgcttcacctatcctactagacgaactaacttcccgaagaaccactacgtgtaactctagacaaaagttgaactagggctagacgacgaccgacgacgtaccggacctaatttacttaaccggcggacgaacggaaagtacgtacggtacgggtacgaacggtaacggtcggtaccgtacggttcgttacgtacgtacgtcg

SEQ ID NO: 373806 - DNA, 555 bp, Homo sapiens
  misc_feature: GZ8MTXP02FP6NA.22.82.H05.1.454.CMB.2.raw
  modified_base (466)..(466): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttgtggctattttaaaacgtgtccagtgtgaggtgcagctggcggagtcgtgggggaggcctggtacaggccgggggggtccctggagactctcctgtgtagcctccggattcacctttagcagacatggcatgagctgggtccgccaggctccgaggggaaggggccggagtggggtgtcagtcattagtagtagtggtagatagaatttaccacacagctccgtggaaacgggccgtcttacacccatcctctagagaactaattcccaagaacacactgtatctagacaaatgactaggctgagngacccgagaccacggacctatttactactgacgacgaaggatacgtacgggcgaacgaacgggtcgactacgtccgtttacagtactcg

SEQ ID NO: 373807 - DNA, 615 bp, Homo sapiens
  misc_feature: GZ8MTXP02JPL2J.22.82.H05.1.454.CMB.2.raw
  modified_base (389)..(389): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttgtggctattttaaaacgtgtccagtgtgaggtgcagctggcggagtcgtgggggaggcctgggtacgaggcccgggggggtccctggagactctcctgtgtagcctccggattcacctttagcagacatggcatgagcgtggggtccccgccgaggcctccggaggggaacggggccggaggtggggtgtcgagtcagttagtagtaggtggtgatagtaatttaccanacagtcctccggtaggaacgggcccgtcttaccgacctactcctacgtaagaacgaacaacttccccaagtaaaccacctactgtactcctagactaaatgaaccgtggactagacgacgaccgacgacgaccggacctatttactacgtggccgtaacggaaaggtactacggtacggggtaccaaagaaccgggtcgacgtacggtccgtttacgagtacgtcg

SEQ ID NO: 373808 - DNA, 579 bp, Homo sapiens
  misc_feature: GZ8MTXP02JHNZH.22.82.H05.1.454.CMB.2.raw
  modified_base (180)..(180): a, c, t, g, unknown or other
  modified_base (228)..(228): a, c, t, g, unknown or other
  modified_base (287)..(287): a, c, t, g, unknown or other
  modified_base (290)..(290): a, c, t, g, unknown or other
  modified_base (292)..(292): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtcggctattttaaaacgngtcagtgtgaggtgcagctggcggagtcgtgggggaggcctggtacgnggccggggggtcccgtgagactctcctgtgtgctccggatctaccttagcagacatggnagngngcgtcggccgcgacgcgcgagggacgggcggaggtggtgtcgtgtagtagttagtagtaggtgtagtagtagtaactacacacacgcgtcgtacggacggaccgtctacacactctactagacgactactaccaacaacaacactacgtactacgtacgacgtaaagtacgtacgtagacgtagagacgaccgacgacgacgactacttactacgtacgacgacgagtaacgtaacgtaacggtacgacgtaacggtacgtacgtacgtacgttacgtacgtagtcg

SEQ ID NO: 373809 - DNA, 669 bp, Homo sapiens
  misc_feature: GZ8MTXP02F1KWP.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagcgtggcggagtcgtgggggaggcctggtacgacgggccgggggtccctggagactctcctgtgtacgcctccggattcacctttagcagacatggcatgagcgtcgggtcccgccgaggccgtaccggaaggggacggggcccggaggtgggtgtcgagtcgtagttagtagtaggtggtagtaattaagtaaactttacccaactaacgaacgtaccgttccggtacgggaaaccggggcccgtacctttacccaccctattccctacgttagaacgaaacctaactttaccccgaaaagaacccaactacgttgtaactcgtacgaactaaaatcgtaactaggctagaacgacgacccgaacgaaccgtaccggaccttaagtttactacgtcggaccgacggaaaggtactacgtaacgggtcgaacgtaacgggtcgtccttacggtacgtttacgaagtactccgg

SEQ ID NO: 373810 - DNA, 599 bp, Homo sapiens
  misc_feature: GZ8MTXP02I5REX.22.82.H05.1.454.CMB.2.raw
  modified_base (227)..(227): a, c, t, g, unknown or other
  modified_base (266)..(266): a, c, t, g, unknown or other
  modified_base (275)..(275): a, c, t, g, unknown or other
  modified_base (278)..(278): a, c, t, g, unknown or other
  modified_base (281)..(282): a, c, t, g, unknown or other
  modified_base (284)..(286): a, c, t, g, unknown or other
  modified_base (288)..(288): a, c, t, g, unknown or other
  modified_base (314)..(314): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctaattttaaaacgtgtcagtgtgaggtgcagctggcggagtcgtgggggaggcctggtacnggccggggggtcctggagctctcctgtgtcgcctcggtntctacttancanacnngnnngngcgcgcgcgcgcgcgaggagggcggnggtggtgtcgagtagtagtagtagtaggtggtagtagtaagtaacttaacacaacgaacgtacgtacgtacggacggaccgtacctacctacctactactactagaacgaactaactaccaacgaacaactactactactactacgacaaatacgtacgtacgacgagagacgacgacgacgacgtacgtacttaacttacgtacgacgacggaaggtaacgtacggtacggtacggtaacggtaacggtacggtaccgtacggtacgttacgtacgtacgtacg

SEQ ID NO: 373811 - DNA, 568 bp, Homo sapiens
  misc_feature: GZ8MTXP02HHC4J.22.82.H05.1.454.CMB.2.raw
  modified_base (418)..(418): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctgggcggagtcgtgggggaggcctggtacgagggcccggggggtccctgagactctcctgtgtagcctcggattcaccttagcagacatggcatgagcgtgggtcccgccaggcctccggaggggaacggggccggaggtggggtgtcgagtcattagtagtaggtggtgatagaatttacacacagctcgtgaacgggcctcttcaccatcctctaganacaacttcccagaacacactgtatctagacaaaatgaactaggctagacgacgccgaacgaccacggacctaatttactacgtgcgacgaaaggtactacgtaccggggtacacgaaacgggtcgacctacggtcgtttacgagtatccg

SEQ ID NO: 373812 - DNA, 572 bp, Homo sapiens
  misc_feature: GZ8MTXP02G33KF.22.82.H05.1.454.CMB.2.raw
  modified_base (378)..(378): a, c, t, g, unknown or other
  modified_base (419)..(419): a, c, t, g, unknown or other
  modified_base (432)..(432): a, c, t, g, unknown or other
  modified_base (442)..(442): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctaattttaaaacgtgtcagtgtgaggtgcagctggcggagtcgtgggggaggcctggtacaggccggggggtccctgagactctctgtgtagcctccggattcacctttagcagacatggcatgagctgggtccgccaggctccgaggggaacggggccggaggtggggtgtcgagtctattagtagtaggtggtgatagtaatttaccanacagacgtccgtgaaggccgcttcacctatctatacggaanactaactaccaanaacactactntactctagactaatagtacgtagacgagacgacgacgacgacgacgtactattactactacgacgacggagtacgtacgtacggtacgacgtaacggtacggtacgtacgtacgttacgtacgtacgtcg

SEQ ID NO: 373813 - DNA, 585 bp, Homo sapiens
  misc_feature: GZ8MTXP02F6649.22.82.H05.1.454.CMB.2.raw
  modified_base (358)..(358): a, c, t, g, unknown or other
  modified_base (371)..(371): a, c, t, g, unknown or other
  modified_base (434)..(434): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctagtggctatttaaacgtgtcagtgtgaggtgcagcgtggcggagtcgtgggggaggcctggtacgaggccgggggggtcctgagctctcctgtgtagcctcggattcacctttagcagacatggcatgagcgtgggccgccaggctccgaggggaacggggccggaggtgggtgtcgagtctagttagagtagtggtnatagaattaccanaacagactccgtaggaacggggcctcttacacctatccttcaagacaacaattccccgaaaanaccactactatactctacactaaagtacgtacgtaggcgagagacgacgacgacgacgtactacttacttacgtacgacgacggaaggtaacgtacgtacggtacggacggtaacggtacggtacgtacgttacgttacgtacgtacgtcg

SEQ ID NO: 373814 - DNA, 563 bp, Homo sapiens
  misc_feature: GZ8MTXP02H8BCU.22.82.H05.1.454.CMB.2.raw
  modified_base (377)..(377): a, c, t, g, unknown or other
  modified_base (507)..(507): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctaattttaaaacgtgtccagtgtgaggtgcagctggcggagtcgtgggggaggcctggtacgaggccgggggggtccctgagactctcctgtgtagcctcggattcaccttagcagacatggcatgagcgtgggtccgccaggcctccgaggggaaggggccggaggtggggtgtcgagtcagttagtagtaggtggtgatagaattaccanacagctcgtagaacggccgcttcaccatctcagacgtaacaacttccccaagaaaccacaactgtaactctagactaaaatgtaaactagggctagagacgaccgacgtacgaccgcctaatttataccngcgacgaaaggctaagacgggtacaacgaacggtgactacgtcgtttacaagatcg

SEQ ID NO: 373815 - DNA, 619 bp, Homo sapiens
  misc_feature: GZ8MTXP02HOT8M.22.82.H05.1.454.CMB.2.raw
  modified_base (224)..(224): a, c, t, g, unknown or other
  modified_base (276)..(276): a, c, t, g, unknown or other
  modified_base (278)..(278): a, c, t, g, unknown or other
  modified_base (280)..(280): a, c, t, g, unknown or other
  modified_base (282)..(284): a, c, t, g, unknown or other
  modified_base (286)..(286): a, c, t, g, unknown or other
  modified_base (321)..(321): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctaggtggctattttaaaacgtgtcagtgtgaggtgcagctggcggagtcgtgggggagcctggtacnggccgggggggtcctgagactctcctgtgtgcctcggattcaccttagcaananangnnngngcgtcggccgcgcgcgacggacgggacggggcggnggtggtgtcgtagtagtagtagtaggtaggtggtagtagtaagtaacttaacaacacgacgtacgtaccgtacggtacggtaccgtacctaccacctactactactagaacaactaacctaacccaacaaacctaactactactactactagtaactaaactacgtaacgtacgtacgagacgacgaccgaacgacgaccgtactaacttaacgttacgtacgacgacgaacggtaacgtacgtacggtacggaacggtaacggtacggtacgtacgttacgttacgtacgtacgtcg

SEQ ID NO: 373816 - DNA, 622 bp, Homo sapiens
  misc_feature: GZ8MTXP02INUN3.22.82.H05.1.454.CMB.2.raw
  modified_base (375)..(375): a, c, t, g, unknown or other
  modified_base (377)..(377): a, c, t, g, unknown or other
  modified_base (386)..(386): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttagtggctattttaaaacgtgtccagtgtgaggtgcagctggcggagtcgtgggggaggcctgggtacaggccgggggggtccctgagactctcctgtgtagcctcggattcaccttagcagacatggcatgagcgtgggccgcaggctccgaggggaaggggccggaggtggggtgtcaggtcattagtagtaggtggtgatagaatttaccananacgctccgngaaacgggccgcttacaccctaatctctaagacgaacaacttcccaagaaacactaactagtaacttcagacaaatcgtaacgtaggacgtaggacgacggacccgaacgaccgtaaccgtacttaatttaacgttacgtacggaccggtaacggaaacgggtaacgttaacgggtaccggggtaccgaaacggtaacgggtcggtaacgtaccggtcggtttacgacggtactcg

SEQ ID NO: 373817 - DNA, 556 bp, Homo sapiens
  misc_feature: GZ8MTXP02FXTCG.22.82.H05.1.454.CMB.2.raw
  modified_base (375)..(375): a, c, t, g, unknown or other
  modified_base (395)..(395): a, c, t, g, unknown or other
  modified_base (434)..(434): a, c, t, g, unknown or other
  modified_base (437)..(437): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctattttaaaacgtgtccagtgtgaggtgcagctggcggagtcgtgggggaggcctggtacaggccgggggggtccctggagactctcctgtgtagcctccggattcacctttagcagacatggcatgagcgtgggtccgccgaggctccgaggggaaggggccggaggtgggtgtcagtcattagagtagtggtgatagaatttacanacagctcgtgaaggggcccncttcaccatctctagacacaattcccaagaaccacactntancttagacaaatagatagagagagacgacgacgacgacggacctacttattacttgccgacgaggacgtagtacggtcgaacgaacggtacggcgtacgtacgttcgtacggtacgttcg

SEQ ID NO: 373818 - DNA, 577 bp, Homo sapiens
  misc_feature: GZ8MTXP02I1OUK.22.82.H05.1.454.CMB.2.raw
  modified_base (177)..(177): a, c, t, g, unknown or other
  modified_base (258)..(258): a, c, t, g, unknown or other
  modified_base (261)..(261): a, c, t, g, unknown or other
  modified_base (268)..(269): a, c, t, g, unknown or other
  modified_base (271)..(272): a, c, t, g, unknown or other
  modified_base (274)..(276): a, c, t, g, unknown or other
  modified_base (278)..(278): a, c, t, g, unknown or other
  modified_base (304)..(304): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcggtgtgtttctaggtggctattttaaacgngtcagtgtgagtgcagctggcggagtgtggggaggccgtggtacgagccgggggtcccgtgagctctcctgtgtgctcggntcnccttagnnanngnnngngcgtcgcgcgcgcgcgaggaggcggnggtggtgtcgtgtacgtagtagtagtaggtggtagtagtagtaacgttactacacgacgcgtacgtacggacggccgtctcactactctactagacgaacaactaccaacaacaacactagtatactagacaatacgtacgtagtacgtagacgacgacgaccgacgaccgtaccgtacgtttaacgttacgtacgacggacggtaacggtaacgtacgtacggtaacggaacgtaacggtacggtacgtacgtacgttacgtacgtacgtcg

SEQ ID NO: 373819 - DNA, 542 bp, Homo sapiens
  misc_feature: GZ8MTXP02JBK56.22.82.H05.1.454.CMB.2.raw
  modified_base (512)..(512): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccggggggtccctgagactctcctgtgtagcctccggattcacctttagcagacatggcatgagctgggtccgccaggctccgaggggaaggggccggagtgggtgtcagtcattagtagtagtggtgatagaatttaccacacagactccgtagaacgggccgcttcaccatctctagagacaattcccagaaccacactgtatctgacaaatgaactaggctagagacgccgaacgacacggacctagtttatacgtgcgacgaaaggactacgtacgggtnacgaacggtgcgtacgcgtttcaggactcg

SEQ ID NO: 373820 - DNA, 668 bp, Homo sapiens
  misc_feature: GZ8MTXP02ID212.22.82.H05.1.454.CMB.2.raw
  modified_base (441)..(441): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttatttaaacgtgtccagtgtgaggtgcagctggcggagtcgtgggggaggccgtggtacgaggcccggggggtccctggagactctcctgtgtacgcctccggattcacctttagcagacatggcatgagcgtcggggtccccgccgaggcctaccggaggggaacgggggccggaggtggggtgtcgagttcagtttaggtagtaggtggtgataagtaactttaccacaacgagccgtccgtaggaacgggggccctcttcacctactcctanagagactaacttacccaagaaccacactagtactcgtagaacctaaaagtcgtaaccgtagggacttaggaacggacggacccgaacggaaccgaccggtaccttaacttttacttaacgtggaccggaacggaaaacggtaacgttacgggtaaccgggggttaccgaaacgggtaaaccgggttcggtaaccgttaccggttacgtttaccgtaaggtactccgg

SEQ ID NO: 373821 - DNA, 588 bp, Homo sapiens
  misc_feature: GZ8MTXP02GZ9LP.22.82.H05.1.454.CMB.2.raw
  modified_base (519)..(519): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaaacgtgtccagtgtgaggtgcagctggcggagtcgtgggggaggcctggtacgaggccggggggtcctgagactctcctgtgtagcctcggattcaccttagcagacatggcatgagcgtgggtcccgccgaggctaccggaggggaacggggccggaggtggggtgtcgagtctagttagtagtaggtggtagatagtaactttaccacaacagaccgtcgtaggaacggggcccgtcttaccacctatcctactaagacgaactaacttccccaaagaaccactactagtatctagacaaagtgactaggctagagagccgacgtacacggactatttacttacnggaccgtacgaaaggactacggtacgggtcaacgaacgggtcgaccttacggtcgtttcaaggtactcg

SEQ ID NO: 373822 - DNA, 549 bp, Homo sapiens
  misc_feature: GZ8MTXP02F582Y.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtctgggggaggcctggtacaggccgggggggtccctgagactctcctgtgtagcctccggattcacctttagcagacatggcatgagctgggtccgccaggctccgaggggaaggggccggaggtggggtgtcagtcattagtagtagtggtgatagaatttaccacacagactccgtgaaggggccgcttcgaccatctctagagacaattcccaagaacacactgtatctagacaaatgaactaggactgagaggcgacgacacggccatttatactgacgacgaaaggataacgtacgggtcgaacgaacgggtggacctaacggcgttttcaaggacttcg

SEQ ID NO: 373823 - DNA, 584 bp, Homo sapiens
  misc_feature: GZ8MTXP02I556M.22.82.H05.1.454.CMB.2.raw
  modified_base (395)..(395): a, c, t, g, unknown or other
  modified_base (402)..(402): a, c, t, g, unknown or other
  modified_base (435)..(435): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttgtggctattttaaaacgtgtccagtgtgaggtgcagctggcggagtcgtgggggaggcctggtacaggccgggggggtccctggagactctcctgtgtagcctccggattcacctttagcagacatggcatgagctggggtccgccaggctccgaggggaaggggccggaggtggggtgtcgagtcattagtagtagtggtgatagatttaccacacagctccgtgaaggcccgnttcaccntctctagagaacaacttcccaagaccactactntaactctagacaaattcgactagggctagacgacgccgacgacgacggcctaatttactaacgtgacgacggaaaggacttaacggtaccggggttcgaaaccgaaacggggtcggaccttaacggtcgttttaccaaggtacttccgg

SEQ ID NO: 373824 - DNA, 590 bp, Homo sapiens
  misc_feature: GZ8MTXP02GBJCL.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccggggggtccctgagactctcctgtgtagcctccggattcacctttagcagacatggcatgagcgtggggtcccgccgaggctccgaggggaaggggccggaggtgggtgtcgagtcagttagtagtagtggtgatagaatttaccacacagctccgtggaacgggccgcttcgaccatctactagagacaaacttcccaagaaccacactagtatctagacaaaacttgaacttacgggcttagaagacgccgaacgtaacgaccggacctatttaataacgtcggacggtacgaaaggtactaacgtacggggtacaacggtaaacggtgaccgtacggtccgtttactacggaattcgg

SEQ ID NO: 373825 - DNA, 574 bp, Homo sapiens
  misc_feature: GZ8MTXP02FMIMU.22.82.H05.1.454.CMB.2.raw
  modified_base (379)..(379): a, c, t, g, unknown or other
  modified_base (388)..(388): a, c, t, g, unknown or other
  modified_base (397)..(397): a, c, t, g, unknown or other
  modified_base (411)..(411): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctaattttaaaacgtgtccagtgtgaggtgcagctggcggagtcgtgggggaggcctggtacaggccgggggggtccctggagactctcctgtgtagcctccggattcacctttagcagacatggcatgagcgtggggtccgccgaggctccgaggggaaggggccggaggtggggtgtacgaggtcattagagtagtgtgatagaattacanacagctcgngaagggccncttacaccatcctntagagactaacttcccaagaaccacaacttgtactctagacaaagtagacgtagtacgtagacgacgacgacgacgacgtactattactacgtagacgacgaagtacgtacgtacggtacgacgtaacggtacggtacgtacgtacgttacgtacgtacgtcg

SEQ ID NO: 373826 - DNA, 708 bp, Homo sapiens
  misc_feature: GZ8MTXP02HDTOJ.22.82.H05.1.454.CMB.2.raw
  modified_base (281)..(281): a, c, t, g, unknown or other
  modified_base (283)..(283): a, c, t, g, unknown or other
  modified_base (285)..(285): a, c, t, g, unknown or other
  modified_base (287)..(287): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttagtggctattttaaaacgtgtccagtgtgaggtgcagctggcggagtcgtgggggagcctggtacaggccggggggtccctgagctctcctgtgtagcctccggattcaccttagcagacngngnangagcgtcggccgcgacggcgtaccggaggggacggggcggaggtgggtgtcgtagtactagttagtaggttaggtggtagtaagtaacgtaacttaccaactaacgtaacggtaccgtaccgggtaggaaccggggtcccgtaccgttaccgaacctacttaccgtacgtaaacggtaacgaaacctaaaccttaacccgaagtaaaccaactacgttagtactccgtaacgaacgtaaacgtaacgtaacgtacggtacgtaacgaacggaaccggaccggaaccggaaccgaaccggtaccgttaacgtttaacgttacgtacggacggtaacggtaaacggtaacgtaacggtaaccgggtaaccggtaacgtaaccggtacggtaccgtacggttacgtttacgttacgtacgtacg

SEQ ID NO: 373827 - DNA, 650 bp, Homo sapiens
  misc_feature: GZ8MTXP02G7JDC.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggaggcctggtacgaggcccggggggtcctgagactctcctgtgtacgcctcggattcaccttagcagacatggcatgagcgtgggtcccgcaggcctccgaaggggaacggggccggaggtgggtgtcgagtcagttagtagtagtggtgatagtaattaccacacaagctccgtagaacgggccgcttacacctatcctacgtaagaacgaactaaacttccccaaagtaaaccaactaaccttagtaactctagaacctaaaagtcgtaacgttaggcttaggaacgacggacccgaacgaaccgaaccgggtacctaaattttaacttacgacggtaccggaacggaaaagggtaacttaacgggtaaccggggtaacgaaacggtaaacgggtcggtaaccgtacggtccgttttacgacggtaactccgg

SEQ ID NO: 373828 - DNA, 584 bp, Homo sapiens
  misc_feature: GZ8MTXP02I3VBN.22.82.H05.1.454.CMB.2.raw
  modified_base (377)..(377): a, c, t, g, unknown or other
  modified_base (519)..(519): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttgtggctattttaaaacgtgtccagtgtgaggtgcagctggcggagtcgtgggggaggcctggtacaggccggggggtccctggagactctcctgtgtagcctccggattcacctttagcagacatggcatgagctgggtccgccaggctccgaggggaaggggccggaggtggggtgtcgaggtcattagtagtagtggtgatagaatttaccganacagacgtccgtaggaaacggggcccacttcaacctatcctactagagaactaacttcccaagaaccacacgtgtaactctagacaaaatgaacgtagggctagaagacgccgacgaacgtcggacctaatttacttaccgngacgacgaaagtacgtacgtacggcgaacgtaacggtcgacgtacggtcgtttacgacgtactcg

SEQ ID NO: 373829 - DNA, 632 bp, Homo sapiens
  misc_feature: GZ8MTXP02IWI6R.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccggggggtccctgagactctcctgtgtagcctccggattcacctttagcagacatggcatgagctgggtccgccaggctccgaggggaaggggccggagtggggtgtcgagtcagttagtagtagtggtgatagaatttaccacacagctccgtgaaacgggcccgcgttcacccatctctagagacaacttacccaagaacacactagtaatctagaccaaaatacgacgtaaggccgtagaacgacgacccgaacggaaccgaccgggtacctacgttaactttttttaacgacggtacggaccggaaaagggtaacgtaaacgttaaccgggggttaccgaaccggaaaccgggtacgggtaccgttaaccggtccgttttaccgtaggtaacgtttcgg

SEQ ID NO: 373830 - DNA, 585 bp, Homo sapiens
  misc_feature: GZ8MTXP02JNCC3.22.82.H05.1.454.CMB.2.raw
  modified_base (378)..(378): a, c, t, g, unknown or other
  modified_base (488)..(488): a, c, t, g, unknown or other
  modified_base (509)..(509): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttcttgtggctattttaaaacgtgtccagtgtgaggtgcagctggcggagtcgtgggggaggcctggtacaggccgggggggtccctggagactctcctgtgtagcctccggattcacctttagcagacatggcatgagcgtgggtcccgccaggctccgaggggaaggggccggaggtggggtgtcgagtcagttagtagtagtggtgatagtaatttaccganacagcgtccgtggaaacggggccacttcacctatctactaagaagaccaattccccaagaaccaacactagtatctagactaaaatcgactagggctagagacgccgganacacggcctatttacgttacnggaccgacgtaaaggactacgttaccggggacgtacgaacggggtgtacctacggtccgtttacgtagacgttccg

SEQ ID NO: 373831 - DNA, 560 bp, Homo sapiens
  misc_feature: GZ8MTXP02HV3CG.22.82.H05.1.454.CMB.2.raw
  modified_base (436)..(436): a, c, t, g, unknown or other
  modified_base (442)..(442): a, c, t, g, unknown or other
  modified_base (444)..(444): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgcgttttctaggtggctattttaaaacgtgtccagtgtgaggtgcagctggcggagtctgggggaggcctggtacaggccgggggggtccctgagactctcctgtgtagcctccggattcacctttagcagacatggcatgagctggtccgccaggcgtccgacgggaaggggccgggaggtggggtggtcgagtcatagtagtagtggtgagtagaattactacacagactccgtagaagggcgcttcaccactctctagacgacaattcccaacgaacaacactntatctnanaatagtagtagcgtagagacgacgacgacgacgactacttacttacgtgacgacgaaggagtacgtacggtacggacgtaacggtcggtacgtacgtacgttcgttacgtacgtcg

SEQ ID NO: 373832 - DNA, 731 bp, Homo sapiens
  misc_feature: GZ8MTXP02JLUXR.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggtcttaattttaaacgtgtccagtgtgaggtgcagcgtggcggagtcggtgggggacggccgtggtacgacgggcccggggggtccctggagacctccgtccgtggtcgtacgcccgtccggtacttccaaccctttagccagacagtggcatgagcgtcgggtcccgcgaggccgtaccggaaggggaacggggccggtagggtgggtcgtaccgtagtcgtaagtttaaggtagtaggtggtagtaagtaaagtaaactttaaccacgtaacgacgtaccgttacccgggtagggtaaaccgggtcccgtacctttaccgaaacctacttaccgtaccgtaaggaaacgtaaacctaaaccttacccccgaaaagtaaacccacgtaacttagtactcgttacgaactaaaatcggaaaccgtagggacctaggaacgacggacccgaacgaaccacggtaccttaagttacttaacgtcggacggaaacgtaaaggtacgttaacggtaaccgggtaccgaaacggtaacgggtacgtaccgtaacgtcgtttacgacgtactccg

SEQ ID NO: 373833 - DNA, 626 bp, Homo sapiens
  misc_feature: GZ8MTXP02HR0KR.22.82.H05.1.454.CMB.2.raw
  modified_base (380)..(380): a, c, t, g, unknown or other
  modified_base (384)..(384): a, c, t, g, unknown or other
  modified_base (407)..(407): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttggtggctattttaaaacgtgtccagtgtgaggtgcagctggcggagtcgtgggggaggcctggtacaggcccgggggggtccctgagactctcctgtgtagcctccggattcacctttagcagacatggcatgagcgtgggtcccgcaggcctccgaggggaacggggccggaggtggggtgtcagtcatagtagtaggtggtgatagtaatttaccanacancgtcgaggacggcctctacactntctactagacaactacttacccaaagaaccactactgtactacgtagaaactaaagtcgtaacgtaggacgtaggaacggacggacccgtaaccggaaccgtaccggtaccttaaagttttactacgtcggtaaccggacggtaaaaggtacgtacggtaccggggtaacgaacggtaaccgggtcgtaccggttaccggtcgtttacgacgtacgtcg

SEQ ID NO: 373834 - DNA, 577 bp, Homo sapiens
  misc_feature: GZ8MTXP02GEXJ6.22.82.H05.1.454.CMB.2.raw
  modified_base (452)..(452): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttaggtggctaattttaaaacgtgtccagtgtgaggtgcagctggcggagtcgtgggggaggcctggtacaggccggggggtcctgagctctctgtgtagcctccggattcacctttagcagacatggcatgagctggtccgccgacggcgtccgagggaaggggccggaggtggggtggtcgagtcgtagttagtagtagtggtgtagtagtaatttaccacacagactccgtacgaaggaccgcttcacaactctctagagacaacttacccacaacacactatatctaanacaactagacgtagacgagacgacgacgacgacgacgtactacttactacgtcgacgacgaacgtaacgtacgtacggtacgaacgtaacggtacggtacgtacgtacgttacgtacgtacgtcg

SEQ ID NO: 373835 - DNA, 576 bp, Homo sapiens
  misc_feature: GZ8MTXP02JE50C.22.82.H05.1.454.CMB.2.raw
  modified_base (417)..(417): a, c, t, g, unknown or other
  modified_base (432)..(432): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttaggtggctaattttaaaacgtgtccagtgtgaggtgcagctggcggagtcgtgggggagcctggtacaggccggggggtcctgagactctcctgtgtagcctcggattcaccttagcagacatggcatgagctgggccgcaggctccgaggggaaggggccggaggtgggtgtcagtcagttagtagtagtggtgaatagtaatttaccacacgagactccgtaggaaacggggcctcttacaccatcctataaganactaacttcccaaanaaccacactgtactctagactaatagtacgtagacgagagacgacgacgacgacgactacttactacgtacgacgacgaacgtaacgtacgtacggtacggaacgtaacggtacggtacgtacgtacgttacgtacgtacgtcg

SEQ ID NO: 373836 - DNA, 597 bp, Homo sapiens
  misc_feature: GZ8MTXP02JXIK0.22.82.H05.1.454.CMB.2.raw
  modified_base (395)..(395): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccggggggtccctgagactctcctgtgtagcctccggattcacctttagcagacatggcatgagcgtgggtccgccgaggctccggaggggaacggggccggaggtgggtgtcgagtcattagtagtagtggtgatagtaattaccacacagctcggtagacgggccncttcactatcctactagacgaacaacttccccaagaaccactactagtactacttagactaaaatcggaacgtaggcgtagaacgacggaccgaaccgacgacggtacctaatttacgtactggccgtacggaaaggtacgtacggtaccggggttacgaacggtaacggtcggaccttacggtcgtttactacgacttccg

SEQ ID NO: 373837 - DNA, 558 bp, Homo sapiens
  misc_feature: GZ8MTXP02F01GL.22.82.H05.1.454.CMB.2.raw
  modified_base (391)..(391): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggcctggtacaggccggggggtccctgagactctcctgtgtagcctccggattcacctttagcagacatggcatgagctgggtccgcaggctccgaggggaaggggccggagtgggtgtcagtcattagtagtagtggtgatagaatttaccacacagctccgtgaacggggccncttacacatctactagacgaacaattcccaagaaccacactgtaatctagacaaaatcgaactagggctagaacgacgaccgacgaacacggacctaatttactactggcgacgaaaggatacgtaacgggtcgaacgaacggtgactaacgcgtttacacgtatcg

SEQ ID NO: 373838 - DNA, 562 bp, Homo sapiens
  misc_feature: GZ8MTXP02FS18N.22.82.H05.1.454.CMB.2.raw
  modified_base (375)..(375): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccggggggtccctgagactctcctgtgtagcctccggatcacctttagcagacatggcatgagcgtgggtccgccgaggcctccgaggggaaggggccggaggtggggtgtcgagtcattagtagtagtggtgatagaatttaccanacagctccgtgaacgggccgcttacaccatctctagagacaattcccaagaaccacactgtaatctagacaaatcgaactaggctagaacgagaccgagacacggacctaatttactactgacgtacgaaaggtactacgtacgggtcaacgaaacggtcgacgtaacgtcgtttacaggtacttcg

SEQ ID NO: 373839 - DNA, 624 bp, Homo sapiens
  misc_feature: GZ8MTXP02GXGHT.22.82.H05.1.454.CMB.2.raw
  modified_base (561)..(561): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggtcttaattttaaaacgtgtccagtgtgaggtgcagctgggcggagtcgtgggggaggccgtggtacgaggcccgggggggtccctggagactctcctgtgtacgcctccggattcacctttagcagacatggcatgagcgtgggtcccgccgaggcctccggaaggggaacggggccggaggtgggtgtcaggtctagttagtagtaggtggtagaattagtaaatttaccactacaagaccgtccgtaggaaaccggggccgtcttacaccatcctctaaaggacaactaacttccccaaagtaaccactactagtaacttcagaactaaaagtgtaacctagggactaggaacgacggacccgaaacgacgtaccggacctaatttacgttacgngacgaacgaaagacgtacgtacggacgaaacgaacggtcggactacgtcgtttacagtactcg

SEQ ID NO: 373840 - DNA, 560 bp, Homo sapiens
  misc_feature: GZ8MTXP02GJA9Q.22.82.H05.1.454.CMB.2.raw
  modified_base (369)..(369): a, c, t, g, unknown or other
  modified_base (379)..(379): a, c, t, g, unknown or other
  modified_base (388)..(388): a, c, t, g, unknown or other
  modified_base (398)..(398): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccggggggtccctgagactctcctgtgtagcctccggattcacctttagcagacatggcatgagctgggtccgccaggctccgaggggaaggggccggagtgggtgtcagtcattagtagtagtggtgatagaattaccanacagactcgngaagggccnctcaccatcnctagagacaattcccaagaaccacactgtatctagacaaaatcgaactaggctagaagacgaccgaacgacgacggaccctaagtttactaacgtgacgacggaaaggataacgtacggggtacgaacgaaacgggtcggactacgcgttttacagtactcg

SEQ ID NO: 373841 - DNA, 599 bp, Homo sapiens
  misc_feature: GZ8MTXP02GG2UI.22.82.H05.1.454.CMB.2.raw
  modified_base (416)..(416): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggctttttcttgtggctattttaaaacgtgtccagtgtgaggtgcagctggcggagtcgtgggggaggcctggtacaggccgggggggtccctgagactctcctgtgtagcctcggattcacctttagcagacatggcatgagcgtgggtccgccgaggctccgaggggaaggggccggaggtcgggtagtcgagtcagttaggtagtaggtggtagatagaatttaccgactacagactccgtggaaacgggccgcttcaccatcnctagagacaacttcccaagaacacaactgaatctagacaaatcgaactacgggctagagacgaccgacgaccgtacggcctaaatttacttaacgcggaccgacggaaaaggacttaagtaaccggggtaccgaaccgtaacgggtacggacgttaaccggcgttttaccaaggtacttccgg

SEQ ID NO: 373842 - DNA, 577 bp, Homo sapiens
  misc_feature: GZ8MTXP02JO33R.22.82.H05.1.454.CMB.2.raw
  modified_base (382)..(382): a, c, t, g, unknown or other
  modified_base (406)..(406): a, c, t, g, unknown or other
  modified_base (423)..(423): a, c, t, g, unknown or other
  modified_base (436)..(436): a, c, t, g, unknown or other
  modified_base (446)..(446): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttagtggctattttaaaacgtgtccagtgtgaggtgcagctggcggagtcgtgggggaggcctggtacaggccgggggggtccctggagactctcctgtgtagcctccggattcacctttagcagacatggcatgagcgtgggtccgccaggcctccgaggggaaggggccggaggtcggggtgtcgagtcagttagtagtaggtggtgatagaatttaccanacagactccggtagaaggggcccnttcaccatctctagganacaattcccaaanaccactactntactctagacaatacgtacgtagacgagagacgaccgacgacgacgactacttacttacgtacgacgacgacgtacgtacgtacggtacgacgaacggtacggtacgtacgtacgttacgtacgtacgtcg

SEQ ID NO: 373843 - DNA, 599 bp, Homo sapiens
  misc_feature: GZ8MTXP02GQVKT.22.82.H05.1.454.CMB.2.raw
  modified_base (303)..(303): a, c, t, g, unknown or other
  modified_base (372)..(372): a, c, t, g, unknown or other
  modified_base (429)..(429): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaacgtgtccagtgtgaggtgcagctggcggagtcgtgggggaggcctggtacgaggccggggggtccctggagactctcctgtgtagcctccggattcacctttagcagacatggcatgagctgggtccncaggctccgaggggaaggggccggagtggggtgtcagtcattagtagtagtggtgatagaatttaccanacagctccgtgaacgggccgcttcaccatctctaagacgactaaattccccgaaaanaaccactaacttgtaactctagacaaatagtaacgtacggacgtagacgacgaccgaaccgaaccgaccggaccgtaactttaacttacgtacgacgacggaaggtaacgtaacgtaacggtaacggaacgaacggtacggtacgtacgtacgttacgtacgtacgtacg

SEQ ID NO: 373844 - DNA, 670 bp, Homo sapiens
  misc_feature: GZ8MTXP02JDBQ3.22.82.H05.1.454.CMB.2.raw
  modified_base (230)..(230): a, c, t, g, unknown or other
  modified_base (416)..(416): a, c, t, g, unknown or other
  modified_base (441)..(441): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctaattttaaaacgtgtccagtgtgaggtgcagctggcggagtcgtgggggaggccgtggtacngggccggggggtccctgagactctcctgtgtacgcctcggattcacctttagcagacatggcatgagcgtgggcccgccgaggccgtccgaaggggaacggggcccggaggtgggtgtcgagtcattagtagtagtggtgatagtaatttaccacacagcctccgtagaacggggcctctacaccntctactagacaacaacttcccaaanaaccactactatactctagaactaaagtcgaacgtacgggtacgtaaggaacggaccgtaacccggaaccggtaaccgtaaccggtaacctttaagttttaaacgttaccggtacgggacccggtaaacgggtaaaggttaaacggttacgggttaaacccggggtaaccgaaaaccgggtaaccggggttacgtacggttaccggttacgtttacgtaacggactccg

SEQ ID NO: 373845 - DNA, 615 bp, Homo sapiens
  misc_feature: GZ8MTXP02HW98T.22.82.H05.1.454.CMB.2.raw
  modified_base (336)..(336): a, c, t, g, unknown or other
  modified_base (441)..(441): a, c, t, g, unknown or other
  modified_base (452)..(452): a, c, t, g, unknown or other
  modified_base (532)..(532): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctgtggctattttaaaacgtgtccagtgtgaggtgcagctggcggagtcgtgggggaggcctggtacgaggccgggggggtccctgagctctcctgtgtagcctccggattcaccttagcagacatggcatgagcgtggtcccgcaggctccgaggggaacggggccggagtggggtntcgagtcagttagtagtagtggtagatagtaatttaccatacagcctccggtaggaaacgggccgtcttacacctatctactaaggacactaattaccccgaaanaacactacgtntactacacgaactaaagtcgtacgtaggacgtaggaacgaccggaccgaacgtaccgaaccgtacttaatttacttacgngacggaacggtaaagtacgtacggtaccgggtacgaacggtaacgggtcggtaccgttaccggttacgtttacgtagtactcg

SEQ ID NO: 373846 - DNA, 782 bp, Homo sapiens
  misc_feature: GZ8MTXP02HLT8B.22.82.H05.1.454.CMB.2.raw
  modified_base (264)..(264): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctaatttaaaacgtgtcagtgtgaggtgcagctggcggagtcgtgggggagcccggtagaggccggggggtccctgagactctcctgtgtagcctccggtnttcgtcttagcagactagtgacagtgagcgtcgggcccgacgaggccgtaccgggaaggggaacggggccggaggtggggtcgtacgtagttactaagtttaggtaggttaggtgggtagtaagtaaacggttaaactttaccgaactaacgtacggtaccgttccgggtaagggaaaccggggtcccgtaccttaccaacccgtaacttcccgtaacgtaagaaaccgtaaaccgtaaaccgttaacccgtaaaccgtaaaccgtaaacctaaccgttaacgttaacgttaccgtacgtaaacgtaaacgtaacgtaacgtaacggtaccgtacggtaacggaaccggaacccggaacccggaacccgtaacccggtaacccgttaacgtttaacgttaacgtaccggtaccggtaacggtaaacggtaaacggttaacggtaaccgggtaaccggtaaccggtaacggtaacggtaccggtaccggttacggttaccgttacgtacgtacgtaccg

SEQ ID NO: 373847 - DNA, 568 bp, Homo sapiens
  misc_feature: GZ8MTXP02FIV7M.22.82.H05.1.454.CMB.2.raw
  modified_base (380)..(380): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttctgtggctaattttaaaacgtgtccagtgtgaggtgcagctggcggagtcgtgggggaggcctggtacgacggccgggggggtccctggagactctcctgtgtagcctccggattcacctttagcagacatggcatgagctgggtccgccgaggctccgaggggaaggggccggaggtggggtgtcaggtcaattagtagtagtggtagatagaatttaccanacagctcgtagaagggccgcttcgaccatctctagacgacaacttcccaagaacacactgtactctagacaaaatcgaacgtaggactgagacgcgacgtacacggcctatttactactgcgacgaaaggactaacgtacgggtcgaacgaacgggtcggtacgtacggtacgtttacgtaggactcg

SEQ ID NO: 373848 - DNA, 722 bp, Homo sapiens
  misc_feature: GZ8MTXP02GXZF5.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggcttaattttaaaacgtgtccagtgtgaggtgcagctggcggagtcgtgggggagccgtggtacgaggccggggggtcctgagactctcctgtgtacgcctcggattcaccttagcagacatggcatgagcgtcgggtcccgccgaggccgtaccggaagggggaacggggccggtaggtggggtcgtcgaggtcgtaagttagtaggtaggtggtagtaacgtagtaactttaaccactacgaagtaccgtccgtaggaacggggccctcgttaccacctatcctactaagacgaactaaacttaccccaaagtaacccactaccgttagtactccgttagaacctaaaagttcgaaacgttacggaccgtaagaacggtaaccgacccggtaaaccggaaccgtaaccgggtaccctttaaaatttaaccgtttaacgcggtaaccggaaaccggtaaaagggtaacgttaaacgggtaaccggggttaaccgtaaaccggaaacggggttcggtaaccgttaccggttaccgttttacgaaacgtacggtttccg

SEQ ID NO: 373849 - DNA, 603 bp, Homo sapiens
  misc_feature: GZ8MTXP02F5WK4.22.82.H05.1.454.CMB.2.raw
  modified_base (376)..(376): a, c, t, g, unknown or other
  modified_base (395)..(395): a, c, t, g, unknown or other
  modified_base (407)..(407): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccggggggtccctgagactctcctgtgtagcctccggattcacctttagcagacatggcatgagcgtcgggtccgccgaggctccgaggggaaggggccggaggtggggtgtcgagtcattagtagtaggtggtgatagaatttaccanacagctcgagaacgggccnctcaccatcctntaagagaacacttacccgaagaaaccacacttagtaactctagaacctaaaagtcgaacgtagggactagaacgacggacccggaacgtaaccgacggacctatttagtacgttggacgacggaaagtaacttacggtaacgggcgaaacgtaaacgggtcgaccgttacggtaccgttttacacggtacttccgg

SEQ ID NO: 373850 - DNA, 630 bp, Homo sapiens
  misc_feature: GZ8MTXP02F5RD5.22.82.H05.1.454.CMB.2.raw
  modified_base (176)..(176): a, c, t, g, unknown or other
  modified_base (221)..(221): a, c, t, g, unknown or other
  modified_base (281)..(283): a, c, t, g, unknown or other
  modified_base (285)..(285): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgttttctagtggctattttaaacgngtcagtgtgagtgcagctggcggagtcgtgggggagcctggtacnggccggggggtccctgagactctcctgtgtagcctccggatcacctttagcagacatggnnngngcgtcggtccgcgacgcgtccggaggggacggggacggaggtggtgtcgagtacgtagttagtaggtagtggtagtagtagtaacttaccacacacgtacgtaccggtacggacggtaccgtacctacacctactactacgtaacgaacgaactaacctacccaacgaaccaactactacgtactacgtacgtacgtaaacgtacgtacgtacgtacgtagacgacgaccgaccgacgaccgtacgtaacgtttacttacgtacgacggacgtaaacggtaacgtaacggtaacggtacgtaacgtaacggtacggtacgtacgttacgttacgtacgtacgtcg

SEQ ID NO: 373851 - DNA, 639 bp, Homo sapiens
  misc_feature: GZ8MTXP02G212B.22.82.H05.1.454.CMB.2.raw
  modified_base (408)..(408): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccgggggggtccctggagactctcctgtgtagcctccggattcacctttagcagacatggcatgagcgtgggtccgccaggcctccgaggggaacggggccggaggtggggtgtcgaggtctagttagtagtaggtggtagatagtaactttaccacacagctccgtaggaacgggccncttcacctatctctaagacgaacaacttccccaagaaccacactgtatctagacaaatcgaactaggctagaacgacggacccgaacgaccgaccggaccctaattttaacttacgtggaccggaacggtaaaaggtaacttaacggtaaccgggggttaccgaaacgtaaaaccgggggttcggaacccggttaacggtccggttttaaccgtaaggtaacgtttcccgg

SEQ ID NO: 373852 - DNA, 652 bp, Homo sapiens
  misc_feature: GZ8MTXP02INRCJ.22.82.H05.1.454.CMB.2.raw
  modified_base (505)..(505): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttcttgtggctattttaaaacgtgtccagtgtgaggtgcagctggcggagtcgtgggggaggccgtggtacaggccggggggtcctgagactctcctgtgtacgccgtcggattctacctttagcagacatggcatgagcgtcgggtcccgcgaggcctaccggaggggaacggggccggaggtggggtcgtcgaggtactgttaagtaggtaggtggtagtagtaagtaactttaccacacgacgtaccgtccggtaggaaaccgggccgtcttaccgaacctactctacgtaagaacgtaaactaccttaacccgaaataaccctaactaacctagtacttccgttaaanactaagtcaaagtcggtacgtaggacgacggaccgaacgaaccgtaccgaccttaagttactacgtacgacgacggacggtacgtaacgggtacggtaaccgaacggtaacggtacgtacgtacggttcgtttacgacgttacgtcg

SEQ ID NO: 373853 - DNA, 553 bp, Homo sapiens
  misc_feature: GZ8MTXP02FRLGC.22.82.H05.1.454.CMB.2.raw
  modified_base (400)..(400): a, c, t, g, unknown or other
  modified_base (415)..(415): a, c, t, g, unknown or other
  modified_base (440)..(440): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctattttaaacgtgtcagtgtgaggtgcagctggcggagtcgtgggggagcctggtacaggccggggggtccctgagactctcctgtgtagcctccggattctacctttagcagacatggcatgagcgtcggccgcaggctccgaggggacggggccggaggtggggtgtcgagtctattagtagtagtggtgatacgtaatttaccacacgagacgtccgaggaacgggtccnctcaccatctcaganacactaccacacacactatatctanacatagagagagagacgacgacgacgacgacgtactattactactcgacgacgagtacgtacgtacggtacgacgtaacggtacgtacgtacgtacgttacgtacgtacgtcg

SEQ ID NO: 373854 - DNA, 619 bp, Homo sapiens
  misc_feature: GZ8MTXP02IMCIE.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggcctggtacgaggccggggggtccctgagactctcctgtgtacgcctccggattcacctttagcagacatggcatgagctgggtccgccaggctccgaggggaacggggccggaggtgggtgtcgagtcagttagtagtaggtggtacgatagtaactttaccacacagctcgaggaacggggcctcgttacacatctactagacgacaacttcccgaagaaccacactcgtactcgtagaacaaaagtcgaacgtaggactagacggacgacccggaacgaaccgaccgggtactaagtttacttaacgtcggaccggaacggtaaagggtacttaacgggtaccgggttaacgaaccggtaacgggtcggtaccgttacggtcgtttacgagacttcccg

SEQ ID NO: 373855 - DNA, 569 bp, Homo sapiens
  misc_feature: GZ8MTXP02F9EF4.22.82.H05.1.454.CMB.2.raw
  modified_base (402)..(402): a, c, t, g, unknown or other
  modified_base (413)..(413): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggaggcctggtacgaggccggggggtccctggagactctcctgtgtagcctccggtattcacctttagcagacatggcatgagcgtggtccgccgaggctccgaggggaaggggccggaggtgggtgtcgagtctagttagtagtagtggtgatagaatttaccactacagctccgtagaacgggccncttcaccatcnctagagacaattcccaagaccacactgtatctagacaaatgacgtaggctagagacgaccgacgaacacggcctaagtttactacgtgacgacgaaaggactacgtacgggtcgaacgaacgggtacgactaacggtcgtttacgacgtacgttcg

SEQ ID NO: 373856 - DNA, 744 bp, Homo sapiens
  misc_feature: GZ8MTXP02JPCHJ.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttcttgtggctattttaaacgtgtccagtgtgaggtgcagctggcggagtcgtgggggaggcctggtacaggccggggggtccctgagactctcctgtgtagcctcggattcaccttagcagacatggacagtgacgtcgtcggtccgccgaggcctaccgggaagggggacggggccgggtagggtggggtcgtacggtacgtacgtagtttaagggttaggtagggttgggtagtaagttaaggtttaaacctttaaccgaacgtacgaacgtaccgttacgggtaacggggaaaccggggtcccgttcgttacccaaccgtacttacccttacgtaaacggtaacgaaaccttaaaccgttaccccgaaaagtaaaccccaaacgttaccgttaaggttactaccgttacggaaacccttaaagtaccggtaacgttacgggtcctaaggacgaccggacccgaaaccggacgacccggtactttaacgtttacgttacgcggacgtaacggaaaggttacgtaacggtaccgggtaacgaaccgtaaggggtcgtacgtaccggttactttacgtaacgtacttccg

SEQ ID NO: 373857 - DNA, 586 bp, Homo sapiens
  misc_feature: GZ8MTXP02IBUR0.22.82.H05.1.454.CMB.2.raw
  modified_base (394)..(394): a, c, t, g, unknown or other
  modified_base (433)..(433): a, c, t, g, unknown or other
  modified_base (437)..(437): a, c, t, g, unknown or other
  modified_base (485)..(485): a, c, t, g, unknown or other
  modified_base (519)..(519): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggcttaattttaaaacgtgtccagtgtgaggtgcagcgtgggcggaggtcgtgggggacggcctggtacgagggcccgggggggtcctggacgactctcctgtgtagccctccggattcacctttagcagacatggcatgagcgtggggtcccgccgaggccgtccggaagggggacggggccggaggtgggtgtcgagtcagttagtagtggtggtgatagaacttaccaanacagtacctccgtagaacggggcctcttccacatcctanaganactaaagttcccaagaaccacactgtatctagactaaatgaatacggnagagacgacgacgacgtacgactaattactacgngacgacgaagtactacggtacggacgaacggtaacggtcgtacgtacgtacgtttacacgtacgtcg

SEQ ID NO: 373858 - DNA, 546 bp, Homo sapiens
  misc_feature: GZ8MTXP02HUI87.22.82.H05.1.454.CMB.2.raw
  modified_base (496)..(496): a, c, t, g, unknown or other
  modified_base (506)..(506): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggccgtggtacgaggccggggggtcctgagactctcctgtgtacgcctcggattcaccttagcagacatggcatgagcgtgggtccgccaggcctccgaggggaacggggccggaggtggggtgtcgagtcagttagtaggtagtggtgatagtaatttaccacacagctcgtagaacgggcctctcaccatctactagacgactaacttccccaagaaccacactgtatctagacaaatgaactaggctagagacgaccgacgacgacgctattactacngcgagaaganacgtacggcaacgaacggtgactacgcgtttacagtatcg

SEQ ID NO: 373859 - DNA, 679 bp, Homo sapiens
  misc_feature: GZ8MTXP02F3GKN.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaaacgtgtccagtgtgaggtgcagctggcggagtcgtgggggagcctggtacaggccggggggtcctgagactctcctgtgtagcctccggattcacctttagcagacatggcatgagcgtcggggtccgccaggcctacccggaggggaacggggccggaggtggggtgtcgaggtctaagttagtagtaggtggtagtatagtaaatttaccacacgagtaccgtccggtaggaaacggggcccgtccgtttacccaaccctagttaccctacgtaagaacgtaacaacctttaccccgaaagaacccactaaccttagtaaacttccgtaggtaacctaaaattcggaaccgttaggactacggaagacgacccggaacgacgaccgggtaccttaagtttacgttaacgtggaccggtacgaaagggaacttacgggtaaccggggtacaaaccggtaacggggttcggaccgttaccggacgtttttacgaaggtacttccgg

SEQ ID NO: 373860 - DNA, 598 bp, Homo sapiens
  misc_feature: GZ8MTXP02GUAI2.22.82.H05.1.454.CMB.2.raw
  modified_base (406)..(406): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggaggcctggtacgaggccggggggtcctgagactctcctgtgtagcctccggattcacctttagcagacatggcatgagcgtgggtcccgccgaggccgtccgaggggaacggggccggaggtggggtgtcgaggtcattagtagtagtggtgatagtaatttaccacacagactcgtaggaacgggcccncttcacctatcctactagacgaactaacttccccaaagaaaccactacctgtactctagacaaaatcgaacgtaggctagaacgacgaccgacgacgacggacctattaacttacgtcgacgacgaaaggtatacggtaccgggtacgaacgtaacgggtcgtacgtaccggtcgtttaccgtagtacgtcg

SEQ ID NO: 373861 - DNA, 574 bp, Homo sapiens
  misc_feature: GZ8MTXP02HJZ6H.22.82.H05.1.454.CMB.2.raw
  modified_base (375)..(375): a, c, t, g, unknown or other
  modified_base (450)..(450): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctagtggctatttaaacgtgtccagtgtgaggtgcagctggcggagtcgtgggggaggcctggtacaggcccgggggggtccctggagactctcctgtgtagcctcggattcacctttagcagacatggcatgagcgtgggcccgcgaggcctccgaggggaacggggccggaggtgggtgtcgagtcagttagtagtagtggtgatagaatttacanacagacgtccgtgaacggccgtcttcaccatctctagacgactaacttcccaagaaacacaactgtaacttcaanacaaatcgtaacagactagagacgtaccgacgacgacgtactaattactacgacgacgacgaagtaactacggtaccgggaacgaacggtaacggtcgtaccgtacgtcgtttacacgtactcg

SEQ ID NO: 373862 - DNA, 617 bp, Homo sapiens
  misc_feature: GZ8MTXP02I9OJ6.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttggtggcttaattttaaaacgtgtccagtgtgaggtgcagctggcggagtcggtgggggacggcctggtacgacgggcccggggggtccctggagactctcctgtgtagcctccggattcacctttagcagcatggcatgagcgtgggtcccgcgaggctccggaggggaacggggccggaggtggggtgtcgagtcagttagtaggtagtggtagtactaagtaactttaccgacaacagaccgtccggtaggaacgggcccgtcttaccacctatctctaaggacaactacttacccaagaaccacactgtaactctagacaaatcgaaactcggctagacgacgccgaacgacgacggaccttatttactactcggaccgacggaaaggtacgttacggtaccggggtacgaacgaaccgggtcgacgttacggtcgtttacgaaggtacttccg

SEQ ID NO: 373863 - DNA, 743 bp, Homo sapiens
  misc_feature: GZ8MTXP02G2N8C.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggcccggggggtccctggagactctcctgtgtagcctccggattcaccttagcagacatggcatgagcgtcgggtcccgccgaggccgtcccggaaggggaacgggggcccggaggtggggtgtcgtaggtctagtttaaggtaggtaggttggtacgtaagttaagtaaacttttaacccgaactaaccgaacggtaccgttcccgggttagggaaaccgggggtccccgtacctttaccgaacccgtaacttcccttacgttaaacggaacgaaacctaaaacctttacccccgaaaagtaaacccaacctaaccttagtaaacttccttacgaacctaaaaagtcggtaaaccgtagggacctaggaacgaacggacccggaacgaaccgaccgggtaccctaaattttaacgttacgtacggacggaccggaaaaggtaacgttacggtaaccggggtaccgaacggtaaacgggtcggtaccgttaacggtcgttttacgaaggtacttcg

SEQ ID NO: 373864 - DNA, 567 bp, Homo sapiens
  misc_feature: GZ8MTXP02JZRD8.22.82.H05.1.454.CMB.2.raw
  modified_base (151)..(151): a, c, t, g, unknown or other
  modified_base (450)..(450): a, c, t, g, unknown or other
  modified_base (456)..(456): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgngttttctagtggctattttaaaacgtgtcagtgtgaggtgcagctggcggagtctgggggaggcctgggtacaggcccgggggggtccctgagactctcctgtgtagcctccggattcgacctttagcagacatggcatgagctgggtccgcaggctccgaggaaaggggccggaggtgggtgtcaggtcattagtagtaggtggtgagtagaatttaccgacacacgacgtccgagaacgggccgcttcacctatctctagagacaaattcccaagaccacactgtatcagacaatanataggngagagacgacgacgacgacgtactacttacttacgtacgacgacgaacgtaacgtacgtaccggtacggacgtaacggtacggtacgtacgtacgttacgtacgtacgtcg

SEQ ID NO: 373865 - DNA, 621 bp, Homo sapiens
  misc_feature: GZ8MTXP02IZTN8.22.82.H05.1.454.CMB.2.raw
  modified_base (269)..(269): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaacgtgtccagtgtgaggtgcagctggcggagtcgtgggggaggcctggtacgagggccggggggtccctggagactctcctgtgtagcctccggnttcacttagcagacatggcatgagcgtgggtcccgccgaggctaccgaggggaacggggccggaggtgggtgtcgagtcagttagtagtagtggtgatagtattaccacacagcgtccgtaggaacggccgtcttacgacctactctactagacgactaacttcccaagaacactactagtatatagacaaagtgaactaggacgtagacgacggtacccaacggaaccacggacccttatttaacttaccgtggaccgacggtaaaaggctttaaacggtaccggggtaccgaaaccggtaacggggttcggaaccgtttaccgggacgtttttaccgaaggtaacgttcg

SEQ ID NO: 373866 - DNA, 552 bp, Homo sapiens
  misc_feature: GZ8MTXP02H2QAX.22.82.H05.1.454.CMB.2.raw
  modified_base (297)..(297): a, c, t, g, unknown or other
  modified_base (405)..(405): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctagtggctatttaaacgtgtccagtgtgaggtgcagctggcggagtctgggggaggcctggtacaggccgggggggtcctgagactctcctgtgtagcctccggattcacctttagcagacatggcatgagctgggccnccaggctccgaggggaacggggtccggaggtgggtgtcgagtgatagtagtagtggtgtatagtattactacacagactcgtgacggccgcttcacactctctagaanacactacacacacactatatactagactaagtagtacgtagacgagagacgacgacgacgacgtactacttactactacgacgacgaagtacgtacgtacggtacgacgtaacggtacgtacgtacgtacgttacgtacgtacgtcg

SEQ ID NO: 373867 - DNA, 698 bp, Homo sapiens
  misc_feature: GZ8MTXP02HPTQN.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagcgtggcggagtcgtgggggaggccgtggtacgagggcccggggggtcctgagactctcctgtgtacgcctccggattcacctttagcagacatggcatgaacgtcgggtccgccgaggcctaccggaggggaacggggccggaggtgggtcgtcgagtcagttaggtagtagtggtgagtagaatttaccacacagactccggtaggaacggccgtccttccaacctatctactagacgaacaacttcccaagaaccacaacttacgacttcgtacgaactaaaagtcgaacgttaacgggccttagggaagaaccggtacccggaaacggaacccgtaacccggggtaccctttaaagttttaaacgtttaacccgtcgggtacccgggtaacgggaaaacgggtaacttaaacgggtttaaccgggggaccgtaaaaccggtacggggtaacggtaccgtaaccgggttacgtttacgtaaacggtcgttacgtcccg

SEQ ID NO: 373868 - DNA, 630 bp, Homo sapiens
  misc_feature: GZ8MTXP02JXFY9.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccggggggtccctggagactctcctgtgtagcctcggattcacctttagcagacatggcatgagcgtgggtccgccgaggcctccgaggggaacggggccggaggtgggtgtcgagtcattagtagtagtggtgatagtaacttacacacagactccgtagacggtccgcttcaccgtatcctactaagacgaacaacttcccaagaaccacactgtaatcgtagactaaagtcgaacgtaggctaggaacgacgacccggaacgaccgaccggtaccttaatttaacgtttaccgacggacggtaaccggaaagggtacttaaacgggtaccgggggtaccaaacggtaaacgggtcggtaaccgttaccggttacgtttacgtaagggtactttcccgg

SEQ ID NO: 373869 - DNA, 580 bp, Homo sapiens
  misc_feature: GZ8MTXP02GFMZ4.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctgtggctattttaaaacgtgtccagtgtgaggtgcagctggcggagtcgtgggggaggcctggtacaggccggggggtccctgagactctcctgtgtagcctccggattcacctttagcagacatggcatgagctgggccgccaggctccgaggggaaggggccggaggtggggtgtcgaggtctattagtagtaggtggtgatagaatttaccacacagacctccgtggaacgggccgcttcaaccatctctaagacgaacaacttaccccaagaaccacaacttgtactctagacaaatagtacgtacggacgtagagacgacgacgacgacgactacttacttacgtacgacgacgaaggacgtacgtacggtacggacgaacggtacggtacgtacgtacgttacgtacgtacgtcg

SEQ ID NO: 373870 - DNA, 569 bp, Homo sapiens
  misc_feature: GZ8MTXP02I889O.22.82.H05.1.454.CMB.2.raw
  modified_base (375)..(375): a, c, t, g, unknown or other
  modified_base (563)..(563): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaaacgtgtccagtgtgaggtgcagctggcggagtcgtgggggaggcctggtacgaggccggggggtccctggagactctcctgtgtagcctccggattcacctttagcagacatggcatgagcgtgggtccgccaggctccgaggggaaggggccggaggtgggtgtcgagtcattagtagtagtggtgatagtaatttaccanacagctccgtagaacggggccgcttcaccattcctctaagagaacaattcccaagaaccacactgatctagacaaatgactaggctagagacgccgagacacggacctatttactacgtgacgacggaaaggacttacgtaaccggggtcaaacgaacgggtcggacctacggtcgttttacaaggtnttccgg

SEQ ID NO: 373871 - DNA, 619 bp, Homo sapiens
  misc_feature: GZ8MTXP02HJBUM.22.82.H05.1.454.CMB.2.raw
  modified_base (282)..(282): a, c, t, g, unknown or other
  modified_base (284)..(284): a, c, t, g, unknown or other
  modified_base (286)..(286): a, c, t, g, unknown or other
  modified_base (317)..(317): a, c, t, g, unknown or other
tcagacatacgcgtcacgaccggtgctcgatttagtcgagctctctcgcggggtctgagagaggagcccagccctgggattttcaggttgttttcatttggtgatcaggactgaacagagagaactcaccatggagtttgggctgagcgtgtgtttctaggtgctaatttaaacgtgtcagtgtgaggtgcagctggcggagtcgtgggggaggcctggtacgagggcccgggggtcctgagactctctgtgtacgcctcgattcaccttagcagacatggnangngcgtcggccgcgcgcgcggaggacgggcggnggtggtgtcgtagtacgtagttagtagtaggtaggtagtagtaagtaacgtaacaacaacgaacgtaccgtaccggtacggaccggaccgtacctacctacctactactacgtacgacgtaactaactaccaacgaacaactacgtacgtactactacgaactaagtacgtacgtacgtacgtagacgacgaccgacgacgacgtacgtacgttacgtacgtacgacgacgtaacggtaacgtacggtacggtaacgtaacggtaacggtacgtacgtacgttacgttacgtacgtacgtcg

SEQ ID NO: 373872 - DNA, 666 bp, Homo sapiens
  misc_feature: GZ8MTXP02GCAQW.22.82.H05.1.454.CMB.2.raw
  modified_base (223)..(223): a, c, t, g, unknown or other
  modified_base (284)..(284): a, c, t, g, unknown or other
  modified_base (287)..(287): a, c, t, g, unknown or other
  modified_base (323)..(323): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgtttctaggtggctattttaaaacgtgtcagtgtgaggtgcagctggcggagtcgtgggggagcctggtacnggccggggggtccctgagactcgtcctgtgtagcctcggattcactttagcagacatggcntgngcgtcggtccgccgacgcgcgacgggacggggcggnggtggtgtgtagtagtagtagtagtaggtggtagtagtagtaacttaacctaacacgacgacgtaccgtacggaacgggtacccgtacctacctacctactactacgtaacgaacgaactaactacccaacgaaccaactaactacgtactactacgtactaaacgtacgtacgtacggtacgtacgaacgacggaccggaaccgaaccgaccgtaccgttaactttaacgttacgtacggtacggtaacggtaaacggtaaacgtaacggttaacgggtaaccggtaacggtaaacgggtacggtaccgttaccggttacggtttacgttaacgtacgtacg

SEQ ID NO: 373873 - DNA, 620 bp, Homo sapiens
  misc_feature: GZ8MTXP02HBHGR.22.82.H05.1.454.CMB.2.raw
  modified_base (471)..(471): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggtctaattttaaaacgtgtccagtgtgaggtgcagctggcggagtcgtgggggaggccgtggtacgagggccggggggtccctggagactctcctgtgtacgcctccggattcacctttagcagacatggcatgagcgtgggtcccgccaggcgtcccgaggggaacggggccggaggtgggtgtcgaggtcaagttaggtagtagtggtagaataagtaactttaccacacaagcctccgtagaacggccgacttcgaacctacgtctacgtagacgaacaacttccccaagaaaccaacaacgttntaactctacgactaaaatgaacgtaggctagagacgaccgaacgaccgacggaccttatttaacttacgacgcggacgaaaggtaacttacggtaaaccggggcgaacgaaacggtcggtaccgtacgaccgttttagaacgttactcg

SEQ ID NO: 373874 - DNA, 535 bp, Homo sapiens
  misc_feature: GZ8MTXP02GYUBC.22.82.H05.1.454.CMB.2.raw
  modified_base (342)..(342): a, c, t, g, unknown or other
  modified_base (368)..(368): a, c, t, g, unknown or other
  modified_base (372)..(372): a, c, t, g, unknown or other
  modified_base (387)..(387): a, c, t, g, unknown or other
  modified_base (397)..(397): a, c, t, g, unknown or other
  modified_base (402)..(402): a, c, t, g, unknown or other
  modified_base (410)..(410): a, c, t, g, unknown or other
  modified_base (417)..(417): a, c, t, g, unknown or other
  modified_base (421)..(421): a, c, t, g, unknown or other
  modified_base (423)..(423): a, c, t, g, unknown or other
  modified_base (425)..(425): a, c, t, g, unknown or other
  modified_base (427)..(427): a, c, t, g, unknown or other
  modified_base (431)..(431): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttagtggctattttaaaacgtgtccagtgtgaggtgcagctggcggagtcgtgggggaggcctggtacgaggccgggggggtccctggagactctcctgtgtagcctccggattcacctttagcagacatggcatgagctgggccgcaggctccgaggggaaggggccggagtgggtgtcagtnattagagtagtgtgatagaattacanacanactcgagaagggccnttcaccatcncaganacatacanacacacntatnanananaganagagagagacgacgacgacgacgactattatacgtacgacgacgaagaacgtacgtacggtacgacgaacggtacgtacgtacgtacgttacgtacgtacgtcg

SEQ ID NO: 373875 - DNA, 600 bp, Homo sapiens
  misc_feature: GZ8MTXP02H5UDB.22.82.H05.1.454.CMB.2.raw
  modified_base (274)..(274): a, c, t, g, unknown or other
  modified_base (282)..(282): a, c, t, g, unknown or other
  modified_base (284)..(284): a, c, t, g, unknown or other
  modified_base (286)..(286): a, c, t, g, unknown or other
  modified_base (322)..(322): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctattttaaaacgtgtccagtgtgaggtgcagctggcggagtctgggggagcctggtacaggccggggggtccctgagctctctgtgtgcctccggattcacctttagnagacatgnangngcgtcggtccgccgcgcgcggacgggacggggcggnggtggtcgtgtagtgtagtagtagtagtggtgtagtagtaactacacacacgcgtacgtacggacggccgtctactactactctacgtagactaactaactacccacgaacaactactacgtactactacgactaactacgtacgtagtacgtacgacgacgacgacgacgacgtactacttacttacgtacgacggacggtaaacggtaacgtacggtacggtaacggaacggtaacggtacggtacgtacggttacggtttacgttacgtacgtcg

SEQ ID NO: 373876 - DNA, 599 bp, Homo sapiens
  misc_feature: GZ8MTXP02F70FG.22.82.H05.1.454.CMB.2.raw
  modified_base (374)..(374): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttcttgtggctattttaaaacgtgtccagtgtgaggtgcagctggcggagtcgtgggggaggcctggtacaggccgggggggtccctgagactctcctgtgtagcctccggattcacctttgcagacatggcatgagcgtgggtccgccaggctccgaggggaaggggccggaggtggggtgtcgagtcagttagtagtaggtggtagatagaattaccanacagctcgtggaacgggccgcttcacatctctagagacattccccagaaccacactgtaatctagacaaagtcgaactaggctagaacgacgacccgagaccacggacctaattttacgtaacgttcggaccgacggaaaaggtactaacgtaaccgggggtcgaaaccggtaaacggggtcggtaccgttaaaccggtcgtttttaccgaaaggtactttccgg

SEQ ID NO: 373877 - DNA, 674 bp, Homo sapiens
  misc_feature: GZ8MTXP02GSM49.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttctgtggctaattttaaaacgtgtccagtgtgaggtgcagctggcggagtcgtgggggaggcctggtacaggccggggggtccctgagactctcctgtgtagcctcggattcaccttagcagacagtggcatgagcgtcgggccgcgaggccgtaccggaggggaacggggccggaggtggggtctcgaggtctagttagtagtaggtggtcgagtagtaactttaaccgaacacgaacgacgtccgtaggaacggggccctccttacaccctatcctactaaggaacaaactaacgttaccccgaaaacaaccaactacttagtactcgtaacgaactaaagtcgtaacgtaggtacgtaggaacgacggaacccggaccgaaaccgaccgtacttaacgttaactacggacggtaacggtaacggtaaacgtaaacgttaccggtaaccgggtaaccggtaaacggtaacgggtccggtaaccgttaccggttacgtttacgtaacgtacgttccg

SEQ ID NO: 373878 - DNA, 577 bp, Homo sapiens
  misc_feature: GZ8MTXP02F03NO.22.82.H05.1.454.CMB.2.raw
  modified_base (517)..(517): a, c, t, g, unknown or other
  modified_base (528)..(528): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggcctggtacgaggccggggggtccctgagactctcctgtgtagcctccggattcacctttagcagacatggcatgagcgtggggtcccgccgaggcctccggaaggggaacggggccggtaggtggggtgtcagtcatttagtagtagtggtcgatagtaatttaccacacagccgtccgaggaagggccctcttacgacctatcctactaggacactaacttcccaagaacacactgaatcgtagaccaaattcgactaggctaggacgacgccgacgacacggtcctaatttactacngccacgaaagntacgtacgggcaacgtaacggtggacctacgtccgtttacaggacttcg

SEQ ID NO: 373879 - DNA, 666 bp, Homo sapiens
  misc_feature: GZ8MTXP02JRW8F.22.82.H05.1.454.CMB.2.raw
  modified_base (307)..(307): a, c, t, g, unknown or other
  modified_base (590)..(590): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggaggcctggtacgagggccggggggtccctgagactctcctgtgtagcctcggattcaccttagcagacatggcagtgagcgtcgggtcccnccgaggctacccggaggggaacggggccggtaggtggggtgtaccgaggttctaagttaggtaggtaggtggtagtaagtaagtaactttaccacaacgacgaccgtcccggtaggaacggggtcccgtcttaccacctaatcctactaaaggacgtaacctaacttacccgaaagaaacccaactaccgttagttactaccgttagaacctaaaagtcgtaaccgtagggtccgaaggaacggaccgacggaacgaacgccggtaccttattacgttaacgnggtacgacggaaaggtatacggttaccgggacaaccggtaaggtcgtacgtacgttcgtttaccgaagtcgttccg

SEQ ID NO: 373880 - DNA, 614 bp, Homo sapiens
  misc_feature: GZ8MTXP02H1YH4.22.82.H05.1.454.CMB.2.raw
  modified_base (395)..(395): a, c, t, g, unknown or other
  modified_base (437)..(437): a, c, t, g, unknown or other
  modified_base (534)..(534): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccggggggtcctgagactctcctgtgtagcctcggattcaccttagcagacatggcagtgacgcgtcggggtcccgccgaggccgtaccggaggggaaacgggggccgggaggtggggtgtcgaggttcagtttaggtagtaggtggtagataagtaatttaccanacacgcgtccgtaggaacgggccctacttacacctatcctanaagagacaacttcccaaagaaaccactactagtactctagacaaatgaactaggctagagacgaccggacgaaccgtacggacctatttaacgtacnggacgaacggaaaggtaactacggtaaccgggtacgaacgtaacggggtcgaaccgtcgtacgtttaccgagtacttccg

SEQ ID NO: 373881 - DNA, 627 bp, Homo sapiens
  misc_feature: GZ8MTXP02F88PR.22.82.H05.1.454.CMB.2.raw
  modified_base (309)..(309): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggccgtggtacacggccggggggtccctgagactctcctgtgtagcctccggattcacctttagcagacagtggcatgagcgtcggggtcccnccgaggcctccggaaggggaacggggccggtaggtggggtgtcgagtcgtaagttagtagtaggttggtagataagtaaactttaccaactacgagtaccgtccgtaggaaacggggtccctaccgttaccaccgtacttcctacgtaaagacgaacctaacttacccaaagaaaccactacgtagtactctagacaaagtgaacgtagacgtagacgacgaccgacgaacgacggtacctagtttactacgcgtacgacgaaaggtatacgtacgggacgaacgtaacggtgacgtacgtcgtttacgtacgactcg

SEQ ID NO: 373882 - DNA, 644 bp, Homo sapiens
  misc_feature: GZ8MTXP02IXDKQ.22.82.H05.1.454.CMB.2.raw
  modified_base (388)..(388): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaacgtgtccagtgtgaggtgcagctggcggagtcgtgggggagcctggtacgaggcccggggggtcccgagactctcctgtgtagcctccggattccacctttagcagacatggcatgagcgtgggtccgccaggctcgagggaggggccggagtggtgtcagtcattagtagtagtggtgatagatttaccacacagaccgtcgtagaacgggccnccgttaccaccatctacgtagacgaactaacttcccaagaaccactaactgtactactgaaccaaagtacgaacgtaggtcctaggaacgacggacccgacgaaccgaccggtaccctaagtttacgttaccgttacggccggtaacggtaaacggtaacgttaacggtaaccgggggttaaccgaaccggtaaaccggggtaacggtacccgttaacggttaccgtttacgttaacggtaagttacggtaacccg

SEQ ID NO: 373883 - DNA, 615 bp, Homo sapiens
  misc_feature: GZ8MTXP02JXU78.22.82.H05.1.454.CMB.2.raw
  modified_base (297)..(297): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctggtggctattttaaaacgtgtccagtgtgaggtgcagctgggcggaggtcgtgggggaggcctggtacgagggcccgggggggtccctggagactctccgtgtgtagcctcggattcacttagcagacatggcatgngcgtggccgcgagctcgaggggaacggggccggaggtggggtgtcgagtcgtagttagtagaggttttttggagtaataggtaaactttaccaactacacgaccgtccggacggtaacgggggccctccttaccacctactccttactaacggtaacgaactaacttacccgaagaaaccaactacctagtactctacgactaaagtacgacgtaggcgtagagacgaccgacgacgacggtactatttatcgtagccgagaaggactacgtcggtacgaaggaacggtcggtacgtacgtcgttacgtaggtactcg

SEQ ID NO: 373884 - DNA, 563 bp, Homo sapiens
  misc_feature: GZ8MTXP02H4PRG.22.82.H05.1.454.CMB.2.raw
  modified_base (377)..(377): a, c, t, g, unknown or other
  modified_base (417)..(417): a, c, t, g, unknown or other
  modified_base (451)..(451): a, c, t, g, unknown or other
  modified_base (462)..(462): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggctattttaaaacgtgtccagtgtgaggtgcagctggcggagtcgtgggggaggcctggtacgaggccgggggggtcctgagactctcctgtgtagcctcggattcaccttagcagacatggcatgagcgtgggtcccgcaggcctccgaggggaacggggccggaggtggggtgtcagtcagttagtagtagtggtagataagaatttacanacagctccgtagaaacgggcctcttcaccatctacagaanacaacttcccaagaaccacactagtatcctaganaaatagatagnagagacgacgacgacgacggacacttattactacgcgacgaagacgtaagtacggtacgaacgaacggtacggacgtacgtacgttaccgtacgtaagtcg

SEQ ID NO: 373885 - DNA, 629 bp, Homo sapiens
  misc_feature: GZ8MTXP02GSQ6O.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggaggcctggtacgagggcccggggggtccctggacgactctcctgtgtacgcctccggattctacctttagcagacatggcatgagcgtcggtccgccaggctaccggaggggaacggggccggaggtgggtgtcagtcagttagtagtagtggtgatagtaacttaccacacagaccgttccgaggaacggggccctcttacgacctatcctactaagacgtaacaacttacccgaagaaaccactactagtactacgtacgaactaaaagtcgtacgtagggcctagaacggacgacccggaacgaccgaccggaccttaatttacttaacgcggacgacggtaaagagttaacggtaccggggtacaaacggtaacgggtcgtaccgttacggtcgtttacgagtactccg

SEQ ID NO: 373886 - DNA, 656 bp, Homo sapiens
  misc_feature: GZ8MTXP02JVIWU.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgtagctggctttttcttgtggctaattttaaaacgtgtccagtgtgaggtgcagctggcggagtcgtgggggaggcctggtacgaggccggggggtcctgagactctcctgtgtagcctcggattcaccttagcagacatggcatgagcgtgggtcccgccgacggccgtccggaggggaacggggccggtaggtggggtgtcgagtctattagtaggtagtggtagataagtaactttaccacacagccgtaccggtaggaacgggtcccgtacttccgaacctactcctacgtaagacgaacctaaacttccccaaagaacccaactaactagttactcttagactaaagtcgaacgtaggactaggaagacgacccgaacgacgaccggtacctaaatttacgttacgtacggacggaacggtaaaggtacgtaacggtaccggggtacgtaaccggaaacgggttcggtaaccgttaccggttacgtttaccgtaagtacgtttcccgg

SEQ ID NO: 373887 - DNA, 651 bp, Homo sapiens
  misc_feature: GZ8MTXP02IQVB0.22.82.H05.1.454.CMB.2.raw
  modified_base (380)..(380): a, c, t, g, unknown or other
  modified_base (407)..(407): a, c, t, g, unknown or other
  modified_base (412)..(412): a, c, t, g, unknown or other
  modified_base (416)..(416): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggccgtggtacgaggccggggggtccctgagactctcctgtgtagcctccggattcaccttagcagacatggcatgagcgtgggtcccgccgaggcctccgaaggggaaggggccggaggtgggtgtcgagtcagttagtagtagtggtgatagtaatttaccanacagctcgtgaacggccgtcttcaccntctanaganacaattcccaaagaccacacttgatctagaactaaaatcgaacgtaacggctaacggagacggacccgaacggaaccgaaccgggtcccttaaagttttaacgttaacgcgggtaaccggtaaccggtaaaagggtacttaaacggtaacccgggggttaacgaaaccggtaaacccgggggttggtacccgtttaaccggggtccgtttttaaccgtaaggtaactttcccggg

SEQ ID NO: 373888 - DNA, 574 bp, Homo sapiens
  misc_feature: GZ8MTXP02I8CFH.22.82.H05.1.454.CMB.2.raw
  modified_base (305)..(305): a, c, t, g, unknown or other
  modified_base (379)..(379): a, c, t, g, unknown or other
  modified_base (421)..(421): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttgtggctattttaaaacgtgtccagtgtgaggtgcagctggcggagtcgtgggggaggcctggtacaggccgggggggtccctggagactctcctgtgtagcctccggattcacctttagcagacatggcatgagcgtgggtccnccaggctccgaggggaaggggccggaggtggggtgtcgaggtcagttagtagtagtggtgatagtaattaccanacagactcgagaacggggccgcttacacctatctctaagganaactaacttcccaaagaacaactactagtactctagacaaatagtactaggtacgagagacgacgacgacgacgactacttacttactcgacgacgaaggagtacgtacggtacgacgaacggtacggtacgtacgtacgttcgtacgtatcg

SEQ ID NO: 373889 - DNA, 766 bp, Homo sapiens
  misc_feature: GZ8MTXP02F1E9S.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagcctggtacgaggccggggggtcctgagactctcctgtgtagcctcggattcacctttagcagacatggcatgagcgtggccgtccaggctccgaggggaggggccggaggtgggtgtcgagtcagtttagaggtagtggtgatagaatttaccactacagaccgtccggtaggaacggggccgtccgttacaccctacttccctacgttaaacgaacgaaacctaaactttacccccgaacgaaaccaacctaaccgttacgttaaacgttcttaacggaacctaaaagttacggtaacgttacggggaccgttaagggaaaccggaaccgggaaccccggaacccgggtaaaccgaaacccggggtaccccttaaaagtttttaaaccgtttaaccgttacgggtaaccggaacccggggtaaaaggggtaaacgtttaaaccgggttaaacccgggggtaacccggaaaaccgggtaaaacccgggggttacggggtaacccgtttaacccgggtaccgtttttaccggtaaggtaacgtttcccgg

SEQ ID NO: 373890 - DNA, 558 bp, Homo sapiens
  misc_feature: GZ8MTXP02FGYG0.22.82.H05.1.454.CMB.2.raw
  modified_base (446)..(446): a, c, t, g, unknown or other
  modified_base (448)..(448): a, c, t, g, unknown or other
  modified_base (451)..(451): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctaattttaaaacgtgtccagtgtgaggtgcagctggcggagtcgtgggggaggcctggtacacggccggggggtccctggagactctcctgtgtagcctccggattcacctttagcagacatggcatgagcgtgggtccgccaggctccgaggggaaggggccggaggtgggtgtcgagtcattagagtaggtgtgatagaatttaccacacagactccgagaaggccgcttcaccatcctctagagactaacttcccaagaaccacactgtaatctaananaanagacgtagacgagagacgacgacgacgacgactattactactcgacgacgaagacgtacgtacggtacgacgaacggtacgtacgtacgtcgttacgtacgacgtcg

SEQ ID NO: 373891 - DNA, 686 bp, Homo sapiens
  misc_feature: GZ8MTXP02GRDJY.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagcgtggcggagtcgtgggggagccgtggtacgacgggccggggggtccctggagactctccgtgtgtacgccgtccggtattctaccttagcagacagtggcagtgagcgtcggggtcccgccgacggccgtccggaagggggaacggggccgggaggtggggtgtacgaggttacgtagtttaaggtaaggtaggttggtagtaaacgttaagtaaactttaccgaactaacgaacgtaccgtccggtaggaaacggggtccctcttacaacctactcctactaaaggacaaactaaccttacccgaaacgaaacctaacacgttagtacttcgtagacctaaaagttcgaaccgtaagggacctagggaaacgaccggacccggaaacggaccaaccgggtacctaatttaacgtacgtgacggaacgaaaggtacgtacgtacggggacaacgaaccggtgaccgttacgtctttacgtagcttcg

SEQ ID NO: 373892 - DNA, 593 bp, Homo sapiens
  misc_feature: GZ8MTXP02GLUGZ.22.82.H05.1.454.CMB.2.raw
  modified_base (368)..(368): a, c, t, g, unknown or other
  modified_base (403)..(403): a, c, t, g, unknown or other
  modified_base (420)..(420): a, c, t, g, unknown or other
  modified_base (445)..(445): a, c, t, g, unknown or other
  modified_base (585)..(585): a, c, t, g, unknown or other
tcagacatacgcgtcacgaccggtgctcgatttagtcgagctctctcgcggggtctgagagaggagcccagccctgggattttcaggttgttttcattttggtgatcaggactgaacagagagaactcaccatggagtttgggctgagctggtctttttcttgtggtcttattttaaaacgtgtccagtgtgaggtgcagctggcggagtcgtgggggaggccgtggtacgagggccggggggtcctggagactctcctgtgtacgcctccggattcacctttagcagacatggcatgagctggggtcccgccgaggctccgaggggaacggggccggaggtgggtgtcgagtcattagagtagtggngatagaattacacacagctccgtagaacgggcccncttacacatctctaganacacttcccaagaacacactgtacnctagacaaaatcgactaggctagaagacgaccggaacgacgacggacctaatttactacgtacgaccgtacgaaaggtaactacgttaaccggggcgaaacgaacggggtacgaccgttaacggtccgtttacgtaacgngtttaccg

SEQ ID NO: 373893 - DNA, 697 bp, Homo sapiens
  misc_feature: GZ8MTXP02GY04O.22.82.H05.1.454.CMB.2.raw
  modified_base (555)..(555): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctgggcggaggtcgtgggggaggccgtggtacgaggcccggggggtccctggagactctcctgtgtagcctccggattcacctttagcagacatggcatgagcgtcgggtccgccgaggcctaccggaggggaacggggcccgggaggtcggggtgtcgacgtctagtttaagtagtaggtggtagtaacgtaagtaaactttaaccgaacaacgaacgtaccgtccggtaagggaaaccggggtcccgtccgttaccgaacctaacttaccttacctaaaggaactaaacctaaaccttaccccaaagaaacccactaaaccgttgtaaactctagaacaaaattcgaaacgtacggngtagaacgaccgaccgaaacgaccgaaccgtacttaaattacgttacgacggacgtaacggaaagtaacgtacggtaaccggggtaacgaaacggtaacgggtcggtaaccgttacggttaccgtttacgtaacgtacgtcg

SEQ ID NO: 373894 - DNA, 550 bp, Homo sapiens
  misc_feature: GZ8MTXP02I2KOL.22.82.H05.1.454.CMB.2.raw
  modified_base (396)..(396): a, c, t, g, unknown or other
  modified_base (518)..(518): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccgggggggtccctgagactctcctgtgtagcctccggattcacctttagcagacatggcatgagcgtgggtcccgcaggctccgaggggaacggggccggagtgggtgtcagtcagttagtagtagtgtagatagaatttaccacacagctccgtggaacgggccncttcaccatctactagacgacaacttcccaagaccacactgtaatctagaccaaatcgactaggctagagacgccgacgacacggactatttactacgtgacgacgaaggactagacgggtnacgaaggtcgactacgtcgtttacacgagtcg

SEQ ID NO: 373895 - DNA, 708 bp, Homo sapiens
  misc_feature: GZ8MTXP02GLQL4.22.82.H05.1.454.CMB.2.raw
tcagacatacgcgtcacgaccggtgctcgatttagtcgagctctctcgcggggtctgagagaggagcccagccctgggattttcaggttgttttcatttggtgatcaggactgaacagagagaactcaccatggagtttgggctgagctggtctttttcttgtggcttaattttaaaacgtgtccagtgtgaggtgcagctggcggagtcgtgggggaggccgtggtacgagggccggggggtcctggagactctctgtgtacgcctccggtattcacctttagcagacatggcatgagcgtcgggtccgccgaggtcctacccggagggggaacgggggcccggaggtggggtgtcgagtctagttaagtaggtagtggtagatagtaactttaccgacacgagaccgtccggtaggaacgggtccctcgttaccaccctagtccttacgtaaagaacgtaactaaaccttaccccgaaagaaacccaactaccttagtaaacttcgtacggtaaacctaaaagttcggaaccgtagggtaccgttaggaaacggacggaccccggtaaacgaaccgtaccgggtacccttaaattttaaacgtacgttacggaccggtaacggaaaaggtacgttaacggtaccggggttaacgaacggtaacggggtcgtaccgttacggttcgtttaccgtagtaacgtttccg

SEQ ID NO: 373896 - DNA, 615 bp, Homo sapiens
  misc_feature: GZ8MTXP02JNVHA.22.82.H05.1.454.CMB.2.raw
  modified_base (407)..(407): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggcccggggggtccctgagactctcctgtgtagcctccggattcacctttagcagacatggcatgagcgtgggtcccgcgaggcctccgaggggaacggggccggaggtggggtgtcgagtcgagttagtagtaggtggtgatagtaatttaccactacagccgtccgtaggaacgggccncgttcacctatctacgtagaagacaacttcccaaagtaaccaacacctagtactcttagacctaaaagtcgaaccgttaaggcgtaagagacggacccgacgaaccgaccggtacctaagtttaacttaaccgtggaccggacggaaaggtactacgtaaccggggtcaacgtaacggtcgaccgttacgtcgtttactagtactccg

SEQ ID NO: 373897 - DNA, 567 bp, Homo sapiens
  misc_feature: GZ8MTXP02GFL1Q.22.82.H05.1.454.CMB.2.raw
  modified_base (369)..(369): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccggggggtccctgagactctcctgtgtagcctccggattcacctttagcagacatggcatgagctgggtccgccaggctccgaggggaaggggccggagtgggtgtcagtcattagtagtagtggtgatagaatttaccanacagactccgtgaagggccgcttcaccatctctagagaacaattcccaagaaccacactgtaatctagacaaaatcgaactaggactagaagagggacgacgaacgaccggacctaatttaactaactggacgacgaaaaggatacgtaaccggggtcaaacgaaacgggttcggctaacgcgttttacgaagatccg

SEQ ID NO: 373898 - DNA, 606 bp, Homo sapiens
  misc_feature: GZ8MTXP02FM401.22.82.H05.1.454.CMB.2.raw
  modified_base (530)..(530): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgagggccgggggggtccctggagactctcctgtgtagcctccggattcacctttagcagacatggcatgagcgtgggtccgccgaggcctcccgaggggaacggggccggaggtggggtgtcgagtctattagtagtagtggtgatagaactttaccacacagactccgtaggaacgggcccgtcttacacctactactactaggaacaacaaacttccccaaagaaaccacaactgtaactctagacaaaatgaccgtaaggctagagacgacccgaagtacaccggctagtttactacgtcgnggaacggaaaggattaacgaccggggtacgaacgtaaacggggtcgtacgttaccggtcgtttactagacgttccg

SEQ ID NO: 373899 - DNA, 657 bp, Homo sapiens
  misc_feature: GZ8MTXP02JSPN4.22.82.H05.1.454.CMB.2.raw
  modified_base (311)..(311): a, c, t, g, unknown or other
  modified_base (372)..(372): a, c, t, g, unknown or other
  modified_base (389)..(389): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttggctgagctgtactttttcttgtggcttaattttaaaacgtgtccagtgtgaggtgcagctggcggagtcgtgggggacggccgtggtacgacgggcccggggggtccctggagactctcctgtgtacgcctcggattcacctttagcagacatggcatgagcgtgggtcccncgaggcctaccgaggggaacggggccggaggtgggtgtcagtcagttagtagtagtggtanatagtaaactttaccanacgagtaccgtccgtaggaaacggggccctctttaccaccgtaattccgtaccgtaaagacggtaacctaaacgttacccccgaaagtaaacccacctaaccgttagtaactccgtagaactaaaagtcgaaacgttagcgtagaagcgaccgacgactacggccttaagtttactacgtggacacggtaaaggcttaacggtaaccgggtacgaaccgttaacggggtacgtaccccgttaggtcgtttaccgtaaggacttcccgg

SEQ ID NO: 373900 - DNA, 606 bp, Homo sapiens
  misc_feature: GZ8MTXP02GBZ61.22.82.H05.1.454.CMB.2.raw
  modified_base (354)..(354): a, c, t, g, unknown or other
  modified_base (388)..(388): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttcttgtggctattttaaaacgtgtccagtgtgagtgcagctggcggagtcgtgggggaggcctggtacaggccgggggggtccctgagactctcctgtgtagcctccggattcacctttagcagacatggcatgagctgggtccgccagctccgaggggaaggggccggaggtgggtgtcagtcattagtagtaggtggngatagaactttaccacacagctcgtgaagggccnctcaccatctactagagactaacttcccgaagaacacactagtatctacgactaaaagtgaacgttaggaccgtagacgaacggcccgaacgaccgtaacggacccttaatttaacttaacgcggacggaacggaaaagggtattaaaccggtacggggtacctaaccggtaaaacgggtcggaaccgttacggtccttttaccggaatacgttcccg

SEQ ID NO: 373901 - DNA, 572 bp, Homo sapiens
  misc_feature: GZ8MTXP02IUIII.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccgggggggtccctgagactctcctgtgtagcctccggattcacctttagcagacatggcatgagctgggtccgccaggctccgaggggaaggggccggagtgggtgtcagtcagttagtagtagtggtgatagaatttaccacacagctccgtgaaagggcccgcttcaccatctctagagacaacttcccaagaccaacactgtatctagacaaatgacctaggctagagagacccgacgaacgaccggacctaattttacttaacgttggccggaccgaaagggacttaagtaccgggggtacaacgaacgggtcggctacggtctttacctaggacttccg

SEQ ID NO: 373902 - DNA, 565 bp, Homo sapiens
  misc_feature: GZ8MTXP02FGFEP.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccgggggggtccctgagactctcctgtgtagcctccggatcacctttagcagacatggcatgagctgggtccgccaggctccgaggggaaggggccggaggtggggtgtcagtcatttagagtagtggtgatagaatttaccacacagctccgtggaaagggccgcttcaccatctctaagacgacaattaccccagaaaccacactgtaactctagacaaaatgaactaggctagagagccgaagacacggcctatttaactacgtgccgacgaaaggtatacgttacgggacgaacgaaacgggtcggacctacggtccgttttacgagactacg

SEQ ID NO: 373903 - DNA, 569 bp, Homo sapiens
  misc_feature: GZ8MTXP02HOY9Q.22.82.H05.1.454.CMB.2.raw
  modified_base (407)..(407): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaaacgtgtccagtgtgaggtgcagctggcggagtcgtgggggaggcctggtacgaggccggggggtccctgagactctcctgtgtagcctcggattcacctttagcagacatggcatgagcgtgggtccgccaggctccgaggggaaggggccggaggtggggtgtcgagtctagttagtagtagtggtgatagtacttacacacgagctcgtagacgggcctcttacacactctnagagaactaacttcccaacgacactactgtactctagactaaatcgtactaggctagagacgaccgacgacgaccggctaatttacgtactggcggacgaaaggactaacgtacggggtaccaacggaacggtggacttacggtacgtttcaagtactacgg

SEQ ID NO: 373904 - DNA, 592 bp, Homo sapiens
  misc_feature: GZ8MTXP02GH1W7.22.82.H05.1.454.CMB.2.raw
  modified_base (433)..(433): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctaggtggctattttaaaacgtgtccagtgtgaggtgcagctggcggagtcgtgggggaggcctggtacaggccgggggggtccctgagactctcctgtgtagcctccggattcacctttagcagacatggcatgagctgggtccgccgaggctccgaggggaaggggcccggaggtggggtgtcgaggtcagttagtagtagtggtgatagaatttaccacacagactccgtggaagggccgcttcaccatctctagagacaaattccccaaanaaccacactgtactcagaacaaagtgacgtaggctagagacgaccgacgaacgaccggtactaagtttactacgtcggacgaacggaaaggtacgtaacggtacggggtaccgaacggtaacgggtcgacgttaccggttacgtttacgtacgtactcg

SEQ ID NO: 373905 - DNA, 606 bp, Homo sapiens
  misc_feature: GZ8MTXP02FRHAU.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggcctggtacgaggccggggggtccctgagactctcctgtgtagcctccggattcacctttagcagacatggcatgagcgtcgggtcccgccgaggcctccgaaggggaacggggccggaggtggggtgtcgagtctagttagtagtaggtggtagatagtaatttaccacacagaccgtccgtaggaacgggcccgtcttcaaccatcctactaagacgaactaaacttcccaaagaaccacactgtatctgaactaaagtcgaacgtaggactaggaacgacgaccgaacgaaccgacggaccttatttaactacgtgacgacggtaaaggatacggtacgggtacgaacggtaacgggtcgacgtacggtcgtttacgagtacgtcg

SEQ ID NO: 373906 - DNA, 636 bp, Homo sapiens
  misc_feature: GZ8MTXP02HEIE7.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttggtggctaattttaaaacgtgtccagtgtgaggtgcagctggcggagtcgtgggggaggcctggtacaggccggggggtcctgagactctcctgtgtagcctccggattcacctttagcagacatggcatgagcgtcgggtcccgccgacggccgtacccggaagggggaacggggcccggagggtcggggtgtcgagttactagtttaagtagtaggtggtagaatagtaactttaccacacagaccgtccgtaggaacgggccctcgttacaaccgtatcctactaagacgtaactaacttaccccaagaaccactacgtatactccttagaactaaagtcgtaactacggcgtagaacgaccgaccgaacgaccgaccgtacctatttaacgtactgacggacgaaaggactaacgtacgggtacaacgtaaccgggtcgacgttaccggttacgtttacgacgtacgttccg

SEQ ID NO: 373907 - DNA, 667 bp, Homo sapiens
  misc_feature: GZ8MTXP02HUXZ0.22.82.H05.1.454.CMB.2.raw
  modified_base (404)..(404): a, c, t, g, unknown or other
tcagacatacgcgtcacgaccggtgctcgatttagtcgagctctctcgcggggtctgagagaggagcccagccctgggatttttcaggtgttttcatttggtgatcaggactgaacagagagaactcaccatggagtttgggctgagcgtggtcttttcttgtggcttaattttaaaacgtgtccagtgtgaggtgcagctggcggagtcgtgggggagccgtggtacgagggccggggggtcctgacgactctcctgtgtacgcctccggattcaccttagcagacatggcatgagcgtgggtaccgccgaggcctaccggaaggggaacggggccggtaggtcggggtgtcgagtctaagttagttagtaggtggtagtaacttaagtaactttaaccgaanaacgagtcctccggtaggaacgggcccgtacttaccaacctagtcttacaaggaacaacaaaccttaccccgaaagaaaccctactaacctagttactaccgttagaaactaaactggtaaaccgtaggacgtaggaagaccgaccgaacgaaccgtacggtacctaatttaacgtctaggaccgaaacgaaacggtaattacggtaaccgggtacgaaacggtaaacggtcgtacgttaacgtcgtttacgaagtacgtccg

SEQ ID NO: 373908 - DNA, 644 bp, Homo sapiens
  misc_feature: GZ8MTXP02FXW8P.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggccgtggtacgacgggccggggggtccctgagactctcctgtgtacgccgtccggtattctacctttagcagacatggcatgagcgtcgggtcccgccgaggcctaccggaggggaacggggccggtaggtggggtgtcgagtcgtagttagtagtaggtggtagagtagtaactttaccacacgagccgtcggtaggaaacgggcccgtacttaccgacctattcctacgtaagacgaacctaacttacccgaacgaacctacaaccttgtactctagacctaaagtgaactaggctagacgacgaccggaacgacgacggtaccttaatttaacgtacgtggaccgtacggtaaaggtacttacggtaaccggggtacgaaacggtaaccgggtggacttaccggtcgtttacgtaggtacttccg

SEQ ID NO: 373909 - DNA, 719 bp, Homo sapiens
  misc_feature: GZ8MTXP02FVLW9.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagcgtggcggagtcgtgggggaggccgtggtacgaggccgggggtcctgagactctcctgtgtacgcctccggtattcacctttagcagacatggcagtgagcgtcggggtccccgccgaggccgtacccggaagggggaacgggggcccggtaaggggttggggtcgtaccgaggttccgtaaagttttaaggtaaggttaaggttggggtacgtaagttaagtaaactttaacccaacaacacgtaccgtccggtaggaaacggggtccccgtctttaccaacccgtattacctacgtaaagaacgaacaaactttaccccaaagtaaaccaactaaccgttagtaactccgtagaacctaaaagtacgaaccgttaggaccgtaggaacgaaccggaccgaacgaacgaccggtacctaagtttaactaccgtcggacgacggaaaggtacgttacgtaaccgggtaccgaaacggtaaacggtcggtacttacggttaccgtttacgaagtcgttaccg

SEQ ID NO: 373910 - DNA, 830 bp, Homo sapiens
  misc_feature: GZ8MTXP02FO4UL.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctgtactttttcttgtggcttaattttaaaacgtgtccagtgtgaggtgcagctggcggagtcgtgggggaggcctggtacgagggccggggggtccctggagactctcctgtgtacgcctccggtattcctacctttagcagacagtggcatgagcgtcgggtcccgccgaggcctaccggaagggggaacggggcccggaggtggggtgtacgaggttctaagtttaggtaggtaggtggtagtaagttaagtaaactttaaccacgaacgacggtaccgtccgggtagggaaacgggggtcccctacgtttaccaacccgtattacccgttacgtaaacggaacgtaaacctaaaaccgtttcccccgaaaagaaaccctaaccgtaacccgtttagtaaacttccgttaaacggaaaccttaaaaaacgttcggtaaaaccggtttaacgggaccgttaacgggaaacgggaaaccgggacccccggaaaacggtaacccggaaccccggggtaaccctttaaaagtttttaaaccgttaccggttacgggaccggaaaccgggtaaaagggtacgtttaaaccgggttaacccgggggaacctaaaacccggggtaaccggggttaccggtaccgttaacccggggttaccgtttttaaccggaaggttacgttcccgg

SEQ ID NO: 373911 - DNA, 690 bp, Homo sapiens
  misc_feature: GZ8MTXP02F6RN1.22.82.H05.1.454.CMB.2.raw
  modified_base (306)..(306): a, c, t, g, unknown or other
  modified_base (629)..(629): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagcctggtacaggccggggggtccctgagactctcctgtgtagcctccggattcacctttagcagacagtggcatgagcgtcggggtcccnccgaggcctcccggaagggggaaacggggcccggaggttcggggtagtcgaaggtcctaagtttaaggtaagttaggttgggtagtaagttaaagtaaaactttttaacccgaactaaccgaacggtaccgttcccgggttaagggaaaacgggggtcccccgtacctttacccaaacccctaaattcccttaccgttaaagaacgaaacctaaactttcccccaaaagaacccaactaactcgtaaatctaggacaaaatgacgtagctagacggagacgacgacacggacctaagtttactactggaccgacgaaaaggtntaacgtaccggggtcaacggtaaacggtcggacgtaacggtccgttttacagtaacttccg

SEQ ID NO: 373912 - DNA, 574 bp, Homo sapiens
  misc_feature: GZ8MTXP02FTVIQ.22.82.H05.1.454.CMB.2.raw
  modified_base (384)..(384): a, c, t, g, unknown or other
  modified_base (405)..(405): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgagggccgggggggtccctggagactctcctgtgtagcctccggtattcacctttagcagacatggcatgagcgtgggtccgccgaggctccgaggggaaggggccggaggtggggtgtcgagtctagttagagtaggtggtagatagtaatttaccanacagctcgtaggaagggcccncttcaccatctactagagaacaattcccaagaccacactgtatctagacaaatgactaggctagaagacgacccgacgaacaccggacctaattttactacgtcggcgacgaaaggactacgtacggggcaaacggaacggtcggactacggtcgtttacagacttccg

SEQ ID NO: 373913 - DNA, 574 bp, Homo sapiens
  misc_feature: GZ8MTXP02FLWNU.22.82.H05.1.454.CMB.2.raw
  modified_base (386)..(386): a, c, t, g, unknown or other
  modified_base (516)..(516): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaaacgtgtccagtgtgaggtgcagctggcggagtcgtgggggaggcctgggtacgaggccgggggggtccctgagactctcctgtgtagccctccggattcacctttagcagacatggcatgagcgtcggggtccgccgaggctcccggaggggaaggggccggaggtggggtgtcgagtcaagttagtagtaggtggtgatagtaatttaccanacagtacctccggtaggaacggggcccgtcttcgaccctattcctctaagagaactaaattcccaagaacacactgtactctagacaaatgactaggctagacgacgcgacgaacgcgacctattatacngacgacgaaagatacgtacggtacaacgtaacggcgtctacgtcgtttacagtactcg

SEQ ID NO: 373914 - DNA, 776 bp, Homo sapiens
  misc_feature: GZ8MTXP02JF2DB.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctaattttaaaacgtgtccagtgtgaggtgcagctgggcggaggtcgtgggggaggccgtgggtacgacgggcccgggggggtccctggacgactctccgtgtgtacgccgtccggattcacctttagcagacagtggcagtgacgcgtcgggtcccgccgaggccgtaccggaaggggaacggggccggaggtcggggtgtacgagtctaagtttagtaggtaggttggtacgtaagttaaggtaaactttaacccgaactaaacgacgtacccgttaccgggtagggaaaccgggggtcccctaccgtttaacccgaaccctactacccgttacgtaaacgaacggtaaacctaaaccgtttaccccgaaaagaaaccctaactaaccttagtacttccgtacgaaactaaaggttacgaaccggttaggaccgtagaacgggaccgacccggaaaccgaccgacccggtaacctttaagtttaaccgttacgtacggacccggaaacgggtaaaggtaacgttaacgggtaacccggggtaaccgaaaaccgggtaacggggtacggtaaccggttacccggttacgtttaccgttaaggtaacttccgg

SEQ ID NO: 373915 - DNA, 597 bp, Homo sapiens
  misc_feature: GZ8MTXP02JMJPC.22.82.H05.1.454.CMB.2.raw
  modified_base (411)..(411): a, c, t, g, unknown or other
  modified_base (494)..(494): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggctaattttaaaacgtgtccagtgtgaggtgcagctggcggagtcgtgggggaggcctggtacgaggccggggggtccctggagactctcctgtgtagcctccggattcaccttagcagacatggcatgagcgtggggtcccgccgaggcctcccgaggggaacggggccggaggtggggtgtcgagtcagttagagtagtggtagatagtaatttaccacacagaccgtccgtaggaacgggcccncttaccgacctacttctactagacgaactaacttccccaagaaccacactagtatctagactaaatgaactaggctagaacgngaccgacgacaccggactagtttactacgtgacgacgaaaggtactacgtaccgggtacgaacgaacgggtacggaccgttacgtacggtttccagtacgtcg

SEQ ID NO: 373916 - DNA, 714 bp, Homo sapiens
  misc_feature: GZ8MTXP02HDY33.22.82.H05.1.454.CMB.2.raw
  modified_base (433)..(433): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggagcctggtacgaggccggggggtcctgacgactctcctgtgtacgcctcggattcaccttagcagacagtggcagtgagtcgtggggtccccgccgaggccgtccggaagggggaacgggggcccggagggttggggtcgtcgagtctagttaggtagtaggtggtagaagtaagtaactttaccaataccgagtaccgtccggtaggaaaccggggccncgttcaccatcctcgtaagacgaactaacttccccgaagtaaccacaacttagtaactctagaacctaaaagtcggtaaccgttagggaccgttaggaaacggaccggacccggaacggaaaccgacccgggtaccctaaagtttttaaaccgtttacgaccgggtaccggtaaacggtaaaacgggtatttaaaaccggggtaccgggttaaccgaaaccggtaaacggggttcggtaaccgttaaccggtccgtttttaccggaaagtacgtttcccgg

SEQ ID NO: 373917 - DNA, 604 bp, Homo sapiens
  misc_feature: GZ8MTXP02JUK03.22.82.H05.1.454.CMB.2.raw
  modified_base (413)..(413): a, c, t, g, unknown or other
  modified_base (456)..(456): a, c, t, g, unknown or other
  modified_base (464)..(464): a, c, t, g, unknown or other
  modified_base (483)..(483): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttctggtggctattttaaaacgtgtccagtgtgaggtgcagtctggcggagtcgtgggggagcctggtacaggccggggggtcctggagactctcctgtgtagcctcggattcaccttagcagacatggcatgagcgtggtaccgcgaggcctaccgaggggaacggggccggaggtcgggtgtcgaggtctagttagtagtagtggtagtatagtaatttaccactacgacgtacgtccggtaggaaccggggtccncttacaccgtactctacgtagaacgtacaacttcccaagaacncaacgttntactcgagacaagtacganaggactagacgacgaccgtacgacgtacgacttattacgtcgcgacggaacggtaacgacgtaacggtaccgggtacaacggtaacggtcgtaccgtacggttacgttacgacgtacgtcg

SEQ ID NO: 373918 - DNA, 633 bp, Homo sapiens
  misc_feature: GZ8MTXP02IKNUN.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaaacgtgtccagtgtgaggtgcagctgggcggaggtcgtgggggaggcctggtacaggccggggggtccctgagactctcctgtgtagcctccggattcacctttagcagacatggcatgagcgtcggggtcccgccgaggcctcccggaaggggaacgggggccgggaggtggggtgtcgaggtcagtttaggtagtaggtggtgatagtaatttaccacacagcgtccgtaggaacggggcccgtcttacacctatctctaagacgaactaacttaccccaaagaaccacactagtactctagacaaatcgaactagggctagacgagacccgacgaaccgacggacctaatttacttaaccgtggaccgacggtaaagggtaactacggtaaccggggttacgaaaccggtaaacggggtcggtaccgttaccggttccgtttacgtagtacgttccgg

SEQ ID NO: 373919 - DNA, 672 bp, Homo sapiens
  misc_feature: GZ8MTXP02HJME6.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggcttattttaaaacgtgtccagtgtgaggtgcagctggcggagtcgtgggggaggcctggtacgaggcccggggggtcctgagactctctgtgtagcctcggattcaccttagcagacatggcatgagcgtcgggtccgccgacggctcccggaggggacggggccggaggtggggtgtacgagttcaagttaggtagtaggtggtcgaatagtaactttaccaactacagaccgtcccgtaggaaaccggggccctacgttacccaacctacttacctacgttaaacggaacgtaacctaaactttacccccgaaaagtaaacccaacctaccgttagtaactccgttaagaacctaaaatcgtaaacgtagggacttaggaagaccgacccgaacgtacgacggaccttaagtttaacttacgcggacgtacggaaaggtactacggtaccgggtaaccgaacgtaaacggggtcgaccgttaacggcgttttacaggtacttccg

SEQ ID NO: 373920 - DNA, 581 bp, Homo sapiens
  misc_feature: GZ8MTXP02HGPL0.22.82.H05.1.454.CMB.2.raw
  modified_base (367)..(367): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggcttaattttaaaacgtgtccagtgtgaggtgcagctggcggagtcgtgggggagcctgatacgaggccggggggtcctggagactctctgtgtacgcctcggattcaccttagcagacatggcatgagcgtgggtccgccgaggcctaccggaggggaacggggccggaggtgggtgtcgagtcagttagtagtagtggtanatagtaacttacacacagctacgtaggaacggcctctacacctatctacgagacgactaacttcccaagaaccactactagtattacagtacaatagacgtagagagagacgaccgacgaacgaccggactactttacttaacgtcgtaccgacgaacggagtacgtaacggtacgaacgacggtacggtacgtacgtcgtttacgtacggtcg

SEQ ID NO: 373921 - DNA, 613 bp, Homo sapiens
  misc_feature: GZ8MTXP02FUT37.22.82.H05.1.454.CMB.2.raw
  modified_base (306)..(306): a, c, t, g, unknown or other
  modified_base (553)..(553): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttctgtggctaattttaaaacgtgtccagtgtgaggtgcagcgtggcggagtcggtgggggagcctggtacgacgggccggggggtcctgagactctcctgtgacgcctcggattctaccttagcagacagtggcatgagcgtcgggtccnccgaggcgtaccggaggggaacggggccggaggtggggtcgtacgaggtactaagttagtaggtaggtggtagtataagtaaacttaccgacaacgagcgtccgtaggaaacgggtccctacttacaacccagttacctacgtaaaggacaaacctaacttacccgaagaaacctactactagtaactctagaactaaagttcgacgtagcgagacgacgacgacgacgaccgacttagttatacgngacgacgagtactacgtacgacgacgtaacggtcgtaccgtacgtcttacgacgtactcg

SEQ ID NO: 373922 - DNA, 558 bp, Homo sapiens
  misc_feature: GZ8MTXP02FO92J.22.82.H05.1.454.CMB.2.raw
  modified_base (397)..(397): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggaggcctggtacgaggccggggggtccctgagactctcctgtgtagcctccggattcacctttagcagacatggcatgagcgtgggtccgccgaggctccgaggggaaggggccggaggtgggtgtcagtcattagtagtagtggtgatagaatttaccacacagctccgtagaacgggccncttcacctatctctagagacaacttccccaagaaccacactagtactctagacaaatcgaactaggctagaacgagacccgacgaacacggacctaatttatactgcgacgaaagatacgacgggtcaacgtaacggtcgactacggtctttacacgatcg

SEQ ID NO: 373923 - DNA, 669 bp, Homo sapiens
  misc_feature: GZ8MTXP02FZKS8.22.82.H05.1.454.CMB.2.raw
  modified_base (302)..(302): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttctgtggctattttaaaacgtgtccagtgtgaggtgcagctggcggagtcgtgggggagcctggtacacggccggggggtccctgagactctcctgtgtagcctccggtattcacctttagcagtacatggcatgagctggggtccncaggctccgaggggaagggccggagtgggtgtcagtctagttagtagtagtggtacgtatagaatttaccacaacgagaccgtccgtaggaaacggggcccgtacttacgaacctatctacgtaagacgaaactaacttccccgaaaagaacctaacgtacttacgtactacgtaacgaactaaagtacgtaacgtacggacgtacggaaacggaccggtacccggaacgtaaccggaccggtaaccttaacgtttaacgtaacgtacggaacggtaacggtaaacgtaacgttacgggtaaccggtaccggaaacggtaaccgggtacggtaccgttacggttacgtttacgtacgtacgttacgg

SEQ ID NO: 373924 - DNA, 644 bp, Homo sapiens
  misc_feature: GZ8MTXP02JC04D.22.82.H05.1.454.CMB.2.raw
  modified_base (558)..(558): a, c, t, g, unknown or other
  modified_base (580)..(580): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggctaattttaaaacgtgtccagtgtgaggtgcagctggcggagtcgtgggggaggccgtggtacgaggccggggggtccctggagactctccgtgtgtacgcctcggattctaccttagcagacatggcatgagcgtgggtccccgcgaggcctaccgaggggacggggccggaggtgggtgcagtctagttagtagtaggttggtatacgtaagtaactttacccgactaacgagaccgttccgggtaaggaaacgggtcccgccttaccaaccctattacctaccgtaaagaaccgtaaactaaacctttccccgaaaagaaaccctactaaccgttgtaactcgttagaaactaaagtcgaacgttaggctagacgacgaccgtacgaacncggtacctatttacgtaaccgnggacgaacgaagtactacggtacggacaacgtaacggtcgtactacgtcgtttacgagtactcg

SEQ ID NO: 373925 - DNA, 559 bp, Homo sapiens
  misc_feature: GZ8MTXP02I14DY.22.82.H05.1.454.CMB.2.raw
  modified_base (373)..(373): a, c, t, g, unknown or other
  modified_base (392)..(392): a, c, t, g, unknown or other
  modified_base (410)..(410): a, c, t, g, unknown or other
  modified_base (426)..(426): a, c, t, g, unknown or other
  modified_base (436)..(436): a, c, t, g, unknown or other
  modified_base (438)..(438): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctattttaaaacgtgtccagtgtgaggtgcagctggcggagtctgggggagcctggtacaggccggggggtcccgagactctcctgtgtagcctccggattcacctttagcagacatggcatgagctgggtccgccaggctccagggaaggggccggaggtggggtgtcgaggtcattagtagtagtggtgactagaatttacactanacgactccgtgaagggccncttcaccatctactaganacaaattcccagaacnccatgtatcnanaatagacgtagacgtagagacgacgacgacgacgactactactacgtacgacgacgacgtagtacgtacggtacgaacgacggtaacggtacgtacgtacgttacgtacgtacgtacgtcg

SEQ ID NO: 373926 - DNA, 627 bp, Homo sapiens
  misc_feature: GZ8MTXP02GOR25.22.82.H05.1.454.CMB.2.raw
  modified_base (469)..(469): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttaggtggctaattttaaaacgtgtccagtgtgaggtgcagctggcggagtcgtgggggaggcctggtacaggccgggggggtccctggagactctcctgtgtagcctccggattcacctttagcagacatggcatgagcgtgggtcccgccgaggccgtccgaggggaaggggccggaggtggggtgtcagtcagttagtagtagtggtagatagtaatttaccacacagactccgtaggaaacgggccgcttaccaccattcctacgtaacgagaacaaacttccccaaagaaaccacaacttgtaacncttagacaaaattgaaccgttacggactagaaacgacggcccggaacggaacctaccgggaccctaattttacttaacgtgggaccgacggtaaaggacttagtaccggggtacaacgtaaacgggtggtacctacggtccggtttacaagtactccg

SEQ ID NO: 373927 - DNA, 615 bp, Homo sapiens
  misc_feature: GZ8MTXP02HM5OY.22.82.H05.1.454.CMB.2.raw
  modified_base (531)..(531): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccggggggtccctgagactctcctgtgtacgcctccggattcaccttagcagacatggcatgagcgtcggggtcccgccgacggccgtcccgaggggaacggggccggaggtgggtgtcgagtcattagtagtaggtggtgaatagtaatttaccacaacagcctccggtaggaacgggcctcttcacctatctacagagaacaacttcccaagaaactacactgtactcagaccaaaatcggaaactaggcgtagaagacggacccgaacggaaccgaccggtacctaatttaacgttacnggaccgagaaacggtaatacggtaaccggggtacgaaccggtaaacgggtcggtaccgtaccggtcgttttacgaagtactccg

SEQ ID NO: 373928 - DNA, 608 bp, Homo sapiens
  misc_feature: GZ8MTXP02J3USS.22.82.H05.1.454.CMB.2.raw
  modified_base (398)..(398): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggagcctggtacgaggcccgggggtccctgagactctcctgtgtagcctcggattcacctttagcagacatggcatgagcgtgggtccgcaggccgtccgaggggaacggggccggagtggggtgtcgaggtcagttagtagtagtggtgatagtaactttacgactacagcctcgtgaacgggccncgttccaactactctacctaggacgtaaccaaagttccccaggaaaccactacgttagtaactcctagacctaaaatgaacctaggccttagaacgacggtccaacgtaccgacgtactaacgtttattaccgagcgacggtaaagcgttaacgaccggggttacaacggtaaccggtacgtactacggttccgtttaccgtagtctccg

SEQ ID NO: 373929 - DNA, 631 bp, Homo sapiens
  misc_feature: GZ8MTXP02G0Z96.22.82.H05.1.454.CMB.2.raw
  modified_base (361)..(361): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccgggggggtccctggagactctcctgtgtagcctccggattcaccttagcagacatggcatgagcgtgggccgcaggctccggaggggaacggggccggaggtgggtgtcgagtcagttagtggtagtggngatagtaattaccacacagccgtccgtaggaacgggcctcttcaccgatctctagacgacaattcccaagtaacactactgtatccgtgacctaaaatcgtaacgtaggtcgtagaacgacggacccggaacgaccgaccggtaccttaagtttaacttacgtaggaccgtacggtaaaacggtagttaaaccggtacggggtaaccgtaacggtaaacggggtccggtaccgttaaccggttcgtttaccgtaaaaggcgtttaacccg

SEQ ID NO: 373930 - DNA, 590 bp, Homo sapiens
  misc_feature: GZ8MTXP02I6YNI.22.82.H05.1.454.CMB.2.raw
tcagacatacgcgtcacgaccggtgctcgatttagtcgagctctctcgcgggggtctgagagaggagcccagccctgggattttcaggtgttttcatttggtgatcaggactgaacagagagaactcaccatggagtttgggctgagctggtcttttcttgtggctattttaaaacgtgtccagtgtgaggtgcagctggcggagtcgtgggggaggcctggtacaggccgggggggtccctgagactctcctgtgtagcctccggattcacctttagcagacatggcatgagcgtgggtccgcaggctccgaggggaaggggccggaggtgggtgtcagtctattagtagtagtggtgatagaatttaccactacagactccgtaggaacggccgacttcaccatctactaggagaactaagttccccaaagaaccactaactagtaactctagacaaatgactagggctagacgagacccgacggaacacggtacctaatttaacttaacgtcggacgacgtaaagggactaaggtaaccggggtcaaacgaaccgggtgaacctacggtcgtttacaggtaacttcg

SEQ ID NO: 373931 - DNA, 603 bp, Homo sapiens
  misc_feature: GZ8MTXP02FG9KM.22.82.H05.1.454.CMB.2.raw
  modified_base (179)..(179): a, c, t, g, unknown or other
  modified_base (348)..(348): a, c, t, g, unknown or other
  modified_base (371)..(371): a, c, t, g, unknown or other
  modified_base (392)..(392): a, c, t, g, unknown or other
  modified_base (401)..(401): a, c, t, g, unknown or other
  modified_base (425)..(425): a, c, t, g, unknown or other
tcagacatacgcgtcacgaccggtgctcgatttagtcgagctctctcgcgggggtctgagagaggagcccagccctgggattttcaggtgttttcatttggtgatcaggactgaacagagagaactcaccatggagtttgggctgagcgtggcttttctaggtggctattttaaaacgngtccagtgtgagtgcagctgcgagtctgggggaggcctggtacaggccgggggggttccctggacgactctcctgtgtacgcctccggattcacctttagcagacatggcatgagctgggtccgccaggctccgaggggacggggccggagtgggtgtcagtcattagngtagtggtcgatagaactttacncgacaggctccgtgacggccncttcacctntcagtagacgactaactcccgaanaaccacacgtgtactactacacaaactacgtacgtacggacgacgacgacggaccgaacgaaccgaaccggtaccttaacttaacttacgtacggacggaacggaaacggaacgtaacgtaccgggtaccgaaccggaaccggtacggtacggtaccgtacgttacgtacgtacgtcg

SEQ ID NO: 373932 - DNA, 629 bp, Homo sapiens
  misc_feature: GZ8MTXP02GVPXG.22.82.H05.1.454.CMB.2.raw
  modified_base (227)..(227): a, c, t, g, unknown or other
  modified_base (357)..(357): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctaattttaaaacgtgtcagtgtgaggtgcagctggcggagtcgtgggggagcctggtacgnggccgggggggtcctgagactctcctgtgtcgcctcggattcaccttagcagacatggcatgagctggtccgcaggctccgaggggaaggggccggaggtggggtgtcgagtcagttagagtagtggtanagtataactacacacacgctcgaggacggcctctacacatctatagactaactaactacccgaaagacctacgtacgtatactcgtagaactaaagtaacgtacgtacgtacgtacgaacgacggaccggaacgaaccgaccgtaccgtaacgttaacgttacgtacggacggaacggaaacggtaaacggtaacggtaaccgggtaaccggtaaccggtaacgggtacggtaccggttaccggttaccggtttacggttaacgtacgtacg

SEQ ID NO: 373933 - DNA, 595 bp, Homo sapiens
  misc_feature: GZ8MTXP02GTFG1.22.82.H05.1.454.CMB.2.raw
  modified_base (281)..(281): a, c, t, g, unknown or other
  modified_base (284)..(286): a, c, t, g, unknown or other
  modified_base (288)..(288): a, c, t, g, unknown or other
  modified_base (319)..(319): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctaggtggctaattttaaaacgtgtcagtgtgaggtgcagctggcggagtcgtgggggagccgtggtacgaggccgggggggtcctggagctctcctgtgtgcctccggattcacttagcagacntgnnngngcgtcgcgcgcgcgacggagggacgggcggnggtggtcgtcgtagtagtagtagtaggtaggtggtagtagtagtaacttacacacgacgtcgtacgtacggacggaccgtcctactacactactactagaacgaactaactaccaacaacactactatactactatacgtaagtacgtagacgacgtagacgacgacgacgacgacgtactacgttactacgtacgacgacggaacgtaacgtacgtaccggtaacggtaacggtaacggtacggtacgttacggttacgttacgtacgtacgtcg

SEQ ID NO: 373934 - DNA, 587 bp, Homo sapiens
  misc_feature: GZ8MTXP02GEUVA.22.82.H05.1.454.CMB.2.raw
  modified_base (380)..(380): a, c, t, g, unknown or other
tcagacatacgcgtcacgaccggtgctcgatttagtcgagctctctcgcggggtctgagagagtagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggccgtggtacgaggccgggggggtccctgagactctcctgtgtagcctccggattcacctttagcagacatggcatgagcgtgggtcccgccgaggctccgaggggaacggggccggaggtgggtgtcagtcagttagtagtagtggtagatagtaatttaccanacagcctcgtaggaacgggcctctacacatctctagacgaacacttacccaagaaccacgactgtatctagacaaagtcgaagtaggctagaacgacgaccgacgaacgacggactaatttactacgtgacgacggaaaggactaacggtaccgggtcgaaacgaaacgggttcggaccgttaccggtacgtttaccgagtactccg

SEQ ID NO: 373935 - DNA, 560 bp, Homo sapiens
  misc_feature: GZ8MTXP02I0PVE.22.82.H05.1.454.CMB.2.raw
  modified_base (284)..(286): a, c, t, g, unknown or other
  modified_base (288)..(288): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtgttttctaggtggctattttaaaacgtgtccagtgtgaggtgcagctggcggagtctgggggagcctggtacaggccgggggggtccctgagctctctgtgtagcctccggattcacctttagcagacatggnnngngcgtcggtcgcgacgcgtcgagggacggggcggaggtggtgtcgagtactagtagtagtagtggtgtagtagtattactacacacgcgtcgtacgacggcgctcactactactctagacgaactaactaccacgaacacactagtactctagacaaactacgtacgtacgacgtagagacgacgacgacgacgactattactactcgcgacgagacgtacgtacggtacggacgtaacggtacgtacgtacgtacgttacgtacgtacgtcg

SEQ ID NO: 373936 - DNA, 694 bp, Homo sapiens
  misc_feature: GZ8MTXP02J0AIB.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggtcttaattttaaaacgtgtccagtgtgaggtgcagctggcggagtcggtgggggaggccgtggtacgagggcccgggggggtccctggacgactctcctggtgtacgccgtccggattcacctttagcagacatggcatgagcgtgggtcccgcgaggccgtccgaggggaacggggccggaggtggggtgtcgagtcagttaagtagtaggtggtacgaatagtaaactttaccgacacacgtaccgtccggtaggaacggggcccgtacttaccgaacctagtcctacgtaagacgtaactaacttaccccgaagaaaccacgtacctagttactctacgaacaaaagtgaacgttaggccgtaggagaccggtacccgaacggaccaccgggtaccttaaacgttttaacgttaccgtacgggaccggaacggtaaaaggtattaacgggtaacccgggggttacgaaaccggtaaacggggttcggtaccctaccgggttacgtttttaccgaaggtacctttcgg

SEQ ID NO: 373937 - DNA, 679 bp, Homo sapiens
  misc_feature: GZ8MTXP02IWCT5.22.82.H05.1.454.CMB.2.raw
  modified_base (273)..(273): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggcttaattttaaaacgtgtccagtgtgaggtgcagcgtggcggagtcggtgggggaggcctggtacgacgggccggggggtccctgagacctctcctgtgtagccctcggnttcacctttagcagcatggcatgacgcgtcgggcccgccgacggcgtacggagggggtaacggggccggaggtgggtgcaggtctagttagtagtaggtggtagtagtagtaactttaaccacaaccgacgtccgtccggtacggaacgggggccctaccttaccgaccctagtacccttacgtaacgaacgtaaccctaaaccttacccgaaacgtaacccaacttaacttacgtactccttaggaaacctaaagtcgtaacgtagggtactacgaacggacgacccgaggaacctcggtaaccttatttactacggtcgacggaacggtaaaggtactaacgggtaccgggtcgtaaaccggtcgggtacgtacccgttacggtccgtttacgtagtcgttccg

SEQ ID NO: 373938 - DNA, 569 bp, Homo sapiens
  misc_feature: GZ8MTXP02GFIOE.22.82.H05.1.454.CMB.2.raw
  modified_base (403)..(403): a, c, t, g, unknown or other
  modified_base (454)..(454): a, c, t, g, unknown or other
  modified_base (468)..(468): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccggggggggtccctgagactctcctgtgtagcctccggattcacctttagcagacatgggcatgagctgggtccgccaggctccgaggggaaggggtccggagtgggtgtcagtcagttaagtagtaggtggtgatagaatttaccagacagacctccgtaggaaacgggccgntttacaccaatctaccgtagacgacaattcccaagaacacactgtatcganataatgacgtaggntagacgacgaccgacgacgacgtactatttaatacgagcgacggtaagtacgtacgtacgggtacgaacgaacggtcgacgtacgtacgttacgagactcg

SEQ ID NO: 373939 - DNA, 555 bp, Homo sapiens
  misc_feature: GZ8MTXP02F2SH7.22.82.H05.1.454.CMB.2.raw
  modified_base (404)..(404): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccgggggggtccctgagactctcctgtgtagcctccggattcacctttagcagacatggcatgagctggggtccgccaggctccgaggggaaggggccggagtggggtgtcaggtcattagtagtagtggtgatagaatttaccacacagctccgtgaaagggccgcttcaccatcnctagagacaattcccaagacacactgatctagcaaaatgactagggctgagagccgacgacacggcctaatttacttactgcgacgaaagggatacgtaccggggtcaacgaaacgggtggacctaacggcgttttaccaacggattccgg

SEQ ID NO: 373940 - DNA, 554 bp, Homo sapiens
  misc_feature: GZ8MTXP02I974F.22.82.H05.1.454.CMB.2.raw
  modified_base (399)..(399): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccgggggggtccctgagactctcctgtgtagcctccggattcacctttagcagacatggcatgagcgtggggtcccgccaggcctccgaggggaacggggccggaggtggggtgtcgagtcattagtagtaggtggtgatagaactttaccacacagctcgtgaacgggccncttcacatctctagagacaacttcccaagaacacactgtaactctagacaaatgaactaggctagagcgaccgacgacacggctattatactgcgacgaaaggatacgtaacgggtcgaacgaacggtggactacgtacgtttacgacgagttcg

SEQ ID NO: 373941 - DNA, 743 bp, Homo sapiens
  misc_feature: GZ8MTXP02GDZFR.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccggggggtccctgagactctcctgtgtacgcctccggattctacctttagcagacatggcatgagcgtcgggtcccgccgaggccgtaccggaggggaacgggggccggaggtggggtcgtcgaggtctagttaggtagtaaggtggtagtataagtaatttaaccgacaacgtagaccgtccggaggtaaaccgggggccgtaccttaccaacccgtaattaccgttacgtaaacgaacgtaaacctaaactttaccccgaaagaaacccaacgtaacttacgtaacttaccgtacgtaaacctaaaagtcggtaaccgtaggtacccttaggaaacggaaccggaccccgtaaaccgggaaaccgtaacccgggtacccttaaagtttttaactttaaccgtaggaccgtaaccgggtaaaaggtaacgttaacggttaacgggggtccgaaaccggtaaaccggggtcggtaaccgttaccggtccgtttaccgtaacgtcgtttacccgg

SEQ ID NO: 373942 - DNA, 599 bp, Homo sapiens
  misc_feature: GZ8MTXP02F0XE3.22.82.H05.1.454.CMB.2.raw
  modified_base (463)..(463): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccgggggggtccctgagactctcctgtgtagcctccggattcacctttagcagacatggcatgagcgtgggtccgccaggctccgaggggaaggggccggagtggggtgtcgagtctagttagtagtagtggtgatagaatttaccatacagactccggtagaacgggccgcttacacctatctctagagaactaacttcccgagaaacacacttgtaactcgtagactaaaancgtactagggcctagaacgacgacccgaacgaacaccggacctaatttaacgtactggaccgtacggaaaggtactacgtaaccggggtacgaaaccgaacggggttcgacgtacggttcgtttacgagagttccg

SEQ ID NO: 373943 - DNA, 568 bp, Homo sapiens
  misc_feature: GZ8MTXP02FKX6W.22.82.H05.1.454.CMB.2.raw
  modified_base (544)..(544): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagcgtggcggagtcgtgggggaggccgtggtacgagggccggggggtccctggagactctcctgtgtacgcctccggattcacctttagcagacatggcatgagcgtgggtccgccaggcctccgaggggaacggggccggaggtgggtgtcaggtcagttagtagtagtggtgatagaatttaccacacagctccgagaacgggccgcttcaccatctacgtagagaacaattccccaagaaccacactagtatctagacaaaatgactaggctagaagacgaccgaacgacaccggacctatttactactggcgacgaaaggatacgtacgggtacaacgtaacggnggactacggtcgtttacagactcg

SEQ ID NO: 373944 - DNA, 794 bp, Homo sapiens
  misc_feature: GZ8MTXP02FS2TP.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgagggcccggggggtccctggacgactctcctgtgtagcctccggattcacctttagcagacatggcatgagcgtgggtccgcaggctccgaggggaaggggccggaggtggggtgtcgaggtctagttagtagtaggtggtacgattagaaattttaccaacgtaacaacgtacccgttaccggtaggaaaccgggggtccccgtacctttaccgaaaccctaactttcccgttaccgttaaaggaacggtaaaaccttaaactttaccccccgaaaaggtaaacccaaaccggtaaacctttacgggttaaaacttcccgtttaaagggaaaccctaaaaagtttacggaaccgtttaacgggaccttagggaaacgacgggaccccggaacggaaaccgaccgggtaacccttaaattttaattaacccgttggaccggtaaccgggtaaaacgggtaagttaacgggtttaaacccggggtacggaaaaccgtaaaccgggggttacgggtacccgtttaaaccgggttccggttttttaaccggaaggtaaacggtttccccgg

SEQ ID NO: 373945 - DNA, 678 bp, Homo sapiens
  misc_feature: GZ8MTXP02GSJ5J.22.82.H05.1.454.CMB.2.raw
  modified_base (394)..(394): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcggtgggggagccgtggtacgagggcccggggggtccctgacgactcgtcctgtgtacgcctcggattcacttagcagacatggcatgagcgtgggtcccgcgagccgtaccggaggggacggggccggaggtgggtgtcaggtctagttaggtagtggtggtacgtaatagtaacttaccaacanacgcgtcgtaggaacggccgtcttacgacctactctagtacgacgaactaacttcccgaaacgtaacaacctacgtagtactaccgttagaactaaaagtcgtaaacgtacggtacgtagaacgaccggggacccaaacggaccgtacccggacttaacttttaacgttaacccgggtaggaaccggtaaacggtaaaggtaacggttaaccgggtaaccgggtaaccggaacgggtaacgggtcgtaaccggttacggttaccgtttacgtaacgtcgtaccg

SEQ ID NO: 373946 - DNA, 654 bp, Homo sapiens
  misc_feature: GZ8MTXP02JYCD5.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttgtggctaattttaaaacgtgtccagtgtgaggtgcagctggcggagtcgtgggggaggccgtggtacgagggccggggggtccctggagactctcctgtgtagcctcggattcacctttagcagacatggcatgagcgtgggtcccgccgaggcctccggaggggaacggggcggaggtgggtgtcagtcagttagtagtagtggtagagtagtaactttaccacacagacctcgtagaacgggccacttcacctatctctaaagagtaacaacttccccgaaagaaaccacaacttagtacttactagaactaaaacgtcgtaacgtaaggtctagggaacgaccggacccggaaacgaaccgaccggtacctttaagtttaattaccgtaggcgaaacggaaaggtacgttaacgtaaccgggggttacaaaaccgggaacgggttccggtaacgttacccggttacgtttttaaccgagtaacggttcccg

SEQ ID NO: 373947 - DNA, 636 bp, Homo sapiens
  misc_feature: GZ8MTXP02GCS18.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttctgtggctattttaaacgtgtccagtgtgaggtgcagctggcggagtcgtgggggagcctggtacaggccggggggtcctggagactctccgtgtgtagcctccggattcaccttagcagacatggcatgagcgtgggtcccgcgaggcctccggaaggggaacggggcccggaggttggggtgtccgagttcagttagtagtaggtggtgatagtaaatttaccacacagacctccgtaggaacggggccctcttaccacctatcctactaggaacaactaattccccaaagaaccaactaacttgtaactcgtagaacctaaaatacgtaacgtaaggtccgtagaacgacggacccggaaacggaccaccgggtaccctaaatttactaccgtggaccgacgaaaaggtacttaggaaaccggggttcgaaacgtaacggggtcgaccgttacggtcgtttacgacggatttccgg

SEQ ID NO: 373948 - DNA, 585 bp, Homo sapiens
  misc_feature: GZ8MTXP02JUQ73.22.82.H05.1.454.CMB.2.raw
  modified_base (391)..(391): a, c, t, g, unknown or other
  modified_base (403)..(403): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctgggtacgaggcccgggggggtccctgagactctcctgtgtagcctccggattcacctttagcagacatggcatgagcgtgggtccgccaggcctccgaggggaacggggccggaggtgggtgtcgagtcattagtagtagtggtagatagtaatttaccactacagctccgngaacgggccgtnttcaccatctactaagacgacacttacccagaaccacactgtatctagacaaatgacgtagcgtgagacgacgacgacgacggtctaagttactacgtgacggacgaaacggtactaacggtacgggtaccgaaacgtaacggggtcgtaccgtaccggtacggtttaccgtagtaactcgg

SEQ ID NO: 373949 - DNA, 593 bp, Homo sapiens
  misc_feature: GZ8MTXP02I5KR8.22.82.H05.1.454.CMB.2.raw
  modified_base (297)..(297): a, c, t, g, unknown or other
  modified_base (372)..(372): a, c, t, g, unknown or other
  modified_base (411)..(411): a, c, t, g, unknown or other
  modified_base (431)..(431): a, c, t, g, unknown or other
  modified_base (436)..(436): a, c, t, g, unknown or other
  modified_base (445)..(445): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctattttaaaacgtgtccagtgtgaggtgcagctggcggagtctgggggagcctggtacagccggggggtcctgagactctcctgtgtagcctcggattcaccttagcagcatggcatgagcgtgggtcccncaggctcccgaggggaacggggccggagtggggtgtcgagtctagttagtagtagtggtgactagaatttaccanacagactccgtaggaacggcgcttacacatcctctaganacaacttcccaagaacctanaactntactcgtanactaagtacgacgtagactagacgacggaccgacgaacgtaccgtactaatttacgtacgtgacggtaacggtaaaggtaacgtacggtaccgggtacgaaacgtaaccggggttcgtaccgttacggttacgtttacgaagtcgtcg

SEQ ID NO: 373950 - DNA, 660 bp, Homo sapiens
  misc_feature: GZ8MTXP02JNFHG.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggcttaattttaaaacgtgtccagtgtgaggtgcagctggcggagtcgtgggggagcctggtacgaggccggggggtccctgagactctctgtgtacgcctcggattcacttagcagacatggcatgagcgtggtccgccgacggctccgaggggaacggggccggaggtgggtgtcgagtcgagttagtagtaggtggtagagtaagtaactttaccactacagtaccgtccggtaggaaacggggtcccgcttaccacctacttcctacgtaagaacgaactaaacttaccccaaaggtaaaccaactaccgttagttactcgttagacctaaaagttcgaattacgggacctagaacgacgacccggaaacgaccgaaccggtacccttaaatttaccgttaacgtcggacgaccggaaaggtactacggtaaccggggtcaaaccggtaacgggttcggaccgttaacgtcgtttaccgtaggtactttccgg

SEQ ID NO: 373951 - DNA, 800 bp, Homo sapiens
  misc_feature: GZ8MTXP02GY88J.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttagtggctaattttaaaacgtgtccagtgtgaggtgcagctggcggagtcgtgggggagccgtggtacgaggccggggggtcctgagctctcctgtgtagcctcggattcaccttagcagactatggcatgacgcgtcggtcccgccgaggctccggaaggggacggggccggtaggtcggggtagtccgtaggtactagtttaagttaggtaggttggtacgtaagttaaggttaaacttttaacccgaacgtaaccacgtacccgttcgggtaaggaaaccggggtccctccgttacgaccctactccttacgtaaaggacgaaccttaaaccttaccccaaaaggaaccaacctaacttagtaacttccggttaaacgaaacgtaaaacgttacgtaacgtacggtacgtaacggaaccggaaccggaacccggaaccggtaaccggaacccggttaaccgtttaaaacgttttaaacgttaaccggtacgggtaaaccggtaaaccgggtaaaacgggttaaacggttaaaccggggttaaaccgggggttaaaccggaaaccggggtaaaccggggttaccgggttaacccggtttaccggtttaccggtttaaccgttaacggttaacgttaccg

SEQ ID NO: 373952 - DNA, 593 bp, Homo sapiens
  misc_feature: GZ8MTXP02I4J17.22.82.H05.1.454.CMB.2.raw
  modified_base (387)..(387): a, c, t, g, unknown or other
  modified_base (403)..(403): a, c, t, g, unknown or other
  modified_base (454)..(454): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggcctggtacaggccggggggtccctgagactctcctgtgtagcctccggattcacctttagcagacatggcatgagcgtggggtcccgccgaggctcccgaggggaaggggcccggaggtgggtgtcgagtcagttagtagtagtggtgatagtaatttaccgacacgancgtcgtgaacgggccncttcacctatctctagagactaacttacccagaaccacactagtactctanactaaatgactagggctagacgacgaccgacgacgacggacctatttaacttacgtcggaccgacggaaaggtactaacggtaaccggggtacaacggtaaacgggtcggtaccgtacgtacgtttacgtagtactccg

SEQ ID NO: 373953 - DNA, 621 bp, Homo sapiens
  misc_feature: GZ8MTXP02IE4LD.22.82.H05.1.454.CMB.2.raw
  modified_base (237)..(237): a, c, t, g, unknown or other
tcagacatacgcgtcacgaccggtgctcgatttagtcgagctctctcgcggggtctgagagaggagcccagccctgggatttttcaggtgttttcatttggtgatcaggactgaacagagagaactcaccatggagtttgggctgagctggctttttcttgtggcttattttaaacgtgtccagtgtgaggtgcagctgggcggagtcgtgggggagcctggtacaggccgggggtntccctgagactctcctgtgtagcctcggattcacctttagcagacatggcagtgagcgtcggggtcccaccgaggcctccggaagggggaacggggccggaggtggggtgtcgagtctaagttaggtagtaggtggtagagtagtaactttaccacacagtacctcggtaggaacgggcccgtcttacgaccagttcctacgtaagacgaactaaacttccccaaagtaaaccacgtactagtatcctagacaaattgactaggctagagacgaccgacgacgacggtacctatttactacgtgacgtaacggaaaggtactaacggtaccgggtacgaaacgtaacgggtcgtaccgtaccggttccgttttacgaacgtccg

SEQ ID NO: 373954 - DNA, 724 bp, Homo sapiens
  misc_feature: GZ8MTXP02JB0LP.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaacgtgtccagtgtgaggtgcagctggcggagtcgtgggggaggcctggtacgaggccggggggtccctgagactctcctgtgtagcctcggattcaccttagcagacatggcatgagcgtcgggtccgaccgaggccgtaccggaggggaacgggggcccggtaggttggggtgtaccgagttcgtaagttagtaggtaggtggtagtagtaagtaactttacccactacgacgtacctacccggttaggaaacgggggtccccgtacgttccaaaccgtacgttccgtccgttaaaggaaccgtaactaaaccgtttacccccaaagaaaccctactaaccttacggtaacttcgttacggaactaaaacgttacggtacgtaacgggtaccttaggaacggacggacccggaaccgaaccgacccgggtaccttactttaaacgttaccgtcgggaccggaacgggtaaagtacgttaacgggtaaccgggtcgtaaaaccggtaacgggtcggtaccgttacggtacgtttacgtaacggtcttaccgg

SEQ ID NO: 373955 - DNA, 595 bp, Homo sapiens
  misc_feature: GZ8MTXP02IYCI9.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccggggggtcctgagactctcctgtgtagcctccggattcacctttagcagacatggcatgagcgtcgggtcccgcgaggcctccggaggggaacggggccggaggtggggtgtcgagtctagttagtaggtaggtggtagagtagtaatttaccacacagacgtcgtaggaacgggccgtcttcacctatctactagacgactaacttcccaagaaccacactagtactctagaactaaatacgacttaggctaggacgacgaccgacgaacgacgactatttactacgtgacgacggaaaggactacggtacggggtacgaacgtaacggggtcgtaccgtacgtcgtttaccgagtacttccg

SEQ ID NO: 373956 - DNA, 599 bp, Homo sapiens
  misc_feature: GZ8MTXP02IU083.22.82.H05.1.454.CMB.2.raw
  modified_base (259)..(259): a, c, t, g, unknown or other
  modified_base (266)..(266): a, c, t, g, unknown or other
  modified_base (339)..(339): a, c, t, g, unknown or other
  modified_base (378)..(378): a, c, t, g, unknown or other
  modified_base (414)..(414): a, c, t, g, unknown or other
tcagacatacgcgtcacgaccggtgctcgatttagtcgagctctctcgcggggtctgagagaggagcccagccctgggattttcaggttgttttcatttggtgatcaggactgaacagagagaactcaccatggagtttgggctgagctggtcttttcttgtggcttaattttaaacgtgtccagtgtgaggtgcagctggcggagtcgtgggggagcctggtacgagggcccgggggtcctgagactctctgtgtacnccgtcgnttcaccttagcagcatggcatgagcgtcgggtcccgcgaggcctaccgaggggaacggggccggaggtgggtntcgagtcagttagtagtagtggtgatagtaacttaccanacagcgtcgaggaacgggcctcgttacacctatctntagacactaactcccaagacacatactatctagacctaaatcgtaactaggctagaggaccgacggaacacgacgtaccttaagttaactcgtggaccgacggtaaagtaacttaacggtaccgggtacgaaacgtaaccggggtacgtaccgtttaacggtcccgttttagacgtacgtttccg

SEQ ID NO: 373957 - DNA, 667 bp, Homo sapiens
  misc_feature: GZ8MTXP02G0BM5.22.82.H05.1.454.CMB.2.raw
  modified_base (309)..(309): a, c, t, g, unknown or other
  modified_base (455)..(455): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttggtggcttaattttaaaacgtgtccagtgtgaggtgcagctggcggagtcgtgggggaggcctggtacgagggccggggggtcctgagactctccgtgtgtagcctcggattcacctttagcagacatggcatgagcgtggggtcccncgaggctccgagggggaaggggcccggaggtggggtgtcgaggtctaagttagtaggtagtggtagaactagtaactttaccactacagacctccgtaggaacggcccgtcttcaccattctacagacgaactacttacccgaaanaaccactactagtactcgtacgaaactaaacgtcgaacgtaggacgtaggaacgaccggacccgaacgaaccgaccgtacttaacgtttaacgtacgtacggacggtaaacggtaaaggtaacgttaacggtaaccggggtaaccggtaaaccggtaacggggttcggtaaccggttaccggtttaccggtttaacgtaacggttacgtccg

SEQ ID NO: 373958 - DNA, 698 bp, Homo sapiens
  misc_feature: GZ8MTXP02GOYDT.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgaagctggcggagtcgtgggggaggcctggtacgaggccggggggtccctgagactctcctgtgtacgcctccggattctacttagcagacatggcatgagcgtcgggtcccgccgaggcctccggaaggggaacggggccggaggtggggtgtcgagtctaagttaggtagtagtggtgagtagtaactttaccacacagacctccggtagaacggggccctcttaccgaacctatcctactaagaacgaactaaactttaccccaaagtaaaaccaccgtaacttacgtaactaccgttacggaaactaaaagttacgtaaccgttaagggcctagggaagaccggacccggaacgaaccgaaccgggaccttaagttttaacgtaccgtaggtaccggaaccggaaaacggtaagttaaacggttaccgggggtaaccgtaaccggtaaaacggggtcggtaaccgttaacggttcgttttaacgagtaacgttcggtccc

SEQ ID NO: 373959 - DNA, 598 bp, Homo sapiens
  misc_feature: GZ8MTXP02IS520.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttcttagtggctattttaaaacgtgtccagtgtgaggtgcagctggcggagtcgtgggggaggcctggtacaggccggggggtccctgagactctcctgtgtagcctccggattcacctttagcagacatggcatgagcgtgggtcccgccgaggcgtccgaggggaacggggccggaggtgggtgtcgagtcagttagtagtagtggtgatagtaatttaccacacagctcgtagaacggccgcttcacctatctcagacgacaattacccagaaccaacacttagtaactcttagacctaaagtagtacgttaacgggccgtagacgacggacccgtaacgaaccgacggtacctatttacttacgtcgcgacgaaagtagtacgtacggggtacgaacggaacgggtcgaccgttacggtcgtttacctaagacgttcg

SEQ ID NO: 373960 - DNA, 640 bp, Homo sapiens
  misc_feature: GZ8MTXP02GRCUL.22.82.H05.1.454.CMB.2.raw
  modified_base (305)..(305): a, c, t, g, unknown or other
  modified_base (377)..(377): a, c, t, g, unknown or other
  modified_base (444)..(444): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggctattttaaaacgtgtccagtgtgaggtgcagctggcggagtcgtgggggaggcctggtacgaggccggggggtccctgagactctcctgtgtacgcctccggattcacctttagcagacatggcatgagctgggtcccncaggctcccgaggggaacggggccggaggtgggtgtcagtcagttagtagtagtggtgatagaatttaccanacagcgtccgtaggaacgggtcccgcttacaccactctcgtaagacgaacaaacttcccccgaaaanaacctactacgtgtactcgtacgaactaagtacgtaacgtaggtacgtaggacgaccggaccgaacgtaaccgacggtaccttaagtttaactacgtacggacggtaacggtaaaggtaacgttaacgggtaccgggtaacgtaaccggtaacggttcggaaccggtttaccgtcgtttacgtaacgtacgttccg

SEQ ID NO: 373961 - DNA, 588 bp, Homo sapiens
  misc_feature: GZ8MTXP02FKOGX.22.82.H05.1.454.CMB.2.raw
  modified_base (412)..(412): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggcttaattttaaaacgtgtccagtgtgaggtgcagctggcggagtcgtgggggaggccgtggtacgacgggccggggggtccctggagactctccgtgtgtacgccctccggtattccacctttagcagacatggcatgagcgtgggtcccgccgaggctccgaggggaacggggccggagtgggtgtcgagtcattagtagtaggtggtgagtagaatttaccacacagcctcgtgaacgggcccgnttacacatctctagacgacaacttcccgaagtaaccacactgtactctagacaaagtgaacgtaggactagacgagaccgaacgacgacggcctaagtttatacctgacgtacggaaagtactaacgtacgggacgaacgaaacgggtcgactaacggtcgtttacacgtattccg

SEQ ID NO: 373962 - DNA, 719 bp, Homo sapiens
  misc_feature: GZ8MTXP02G2JI2.22.82.H05.1.454.CMB.2.raw
  modified_base (536)..(536): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggtcttaattttaaaacgtgtccagtgtgaggtgcagctgggcggagtcggtgggggagccgtggtacgagggcccggggggtcctaggacgactctccgtgtgtacgcccgtccggtattccaccttagcagacagtggcagtgagcggtcgggtcccgcgacggccgtaccggaagggggaacggggccggaggttggggtcgtacgtagtctaagttaggtagtaggtggtacgtaataagtaactttaccaacacgaacgtccgtaccgtaggaaaccggggtcccgttccttacccaacctacgttacctacgtaaacgaacgtaaacctaaacttacccgaaagaaaccactaactagtactacgtanaaactaaagtcgtaacgacggtacgagaacggaccgaacccggaacgaaccgaaccggtacccttaaatttaacgttaacgcggaacggtaacggaaagtaaacgttacgggtaaaccgggtacgaaacggaaaccgggttcggaaccgttaaccgggtcgtttacgtaacgtacgttcccgg

SEQ ID NO: 373963 - DNA, 603 bp, Homo sapiens
  misc_feature: GZ8MTXP02F4GZ4.22.82.H05.1.454.CMB.2.raw
  modified_base (382)..(382): a, c, t, g, unknown or other
  modified_base (409)..(409): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgtttttcttgtggcttaattttaaaacgtgtccagtgtgaggtgcagctggcggagtcgtgggggaggcctggtacaggccgggggggtccctggagactctcctgtgtagcctccggattcacctttgcagacatggcatgagcgtgggtccgccaggcctccgaggggaaggggccggaggtgggtgtcgagtctagttagtagtagtggtagatagaatttaccanacagtactccgtaggaaacggggcccncttaccaaccctattcctcgtaagacgaactaaatttccccaaaagaaccactacctgtactcctagacaaaatcgtacgtaaggcgtagaacgagcccgaacgacgtaccggacctatttataaccgtgaccgacgaaaggataacgtacggacgaacgaacggtgacgtaacggtcgtttacaagtacttcg

SEQ ID NO: 373964 - DNA, 666 bp, Homo sapiens
  misc_feature: GZ8MTXP02IOF9Z.22.82.H05.1.454.CMB.2.raw
  modified_base (229)..(229): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagcgtggcggagtcgtgggggaggcctggtacgnggcccggggggtccctgagactctcgtgtgtacgcctccggattcaccttagcagacagtggcatggagcgtcgggtccccgccacggcgtccggaaggggaacggggccggaggtcggggtgtcagtcagttagtagtaggtggtagtagtagtaacttaaccacacgacgactccggtaggaacggggccctcgttacacctatctactaggacactaacttcccaagacctaactaccttagtaaactcgtagtactaaaacgttgaacgttacggcgtaaggaggaccgacccggaacgaaaccgaccgggtaaccctaagttttaaccttaccgtacggtacccggacgggtaaaagaacgttaacgggtaaacggggtccgaaacggtaaacgggttcgacgtttaccggtcgtttacgtagtacgttccg

SEQ ID NO: 373965 - DNA, 685 bp, Homo sapiens
  misc_feature: GZ8MTXP02J3ME2.22.82.H05.1.454.CMB.2.raw
  modified_base (474)..(474): a, c, t, g, unknown or other
tcagacatacgcgtcacgaccggtgctcgatttagtcgagctctctcgcggggtctgagagaggagcccagccctgggattttcaggttgttttctatttggtgatcaggactgaacagagagaactcaccatggagtttgggctgagcgtggtctttttcttgtggtcttaattttaaaacgtgtccagtgtgaggtgcagcgtgggcggaggtcggtgggggacggccgtgggtaccgacggggtcccggggggtccctggacgaccttcctccgtggtgtacgcccttccggtacttcctacctttagcagacagtggctagtggagccgtcgggtcccgccgacggccgtacggacgggggaaggggccggaggtggggtgcgtagtctagtttaaggtagtaggtggtagaacgttaagtaactttaccactacgacgtccgtccgtaggaccgggcctctaccaaccnttactaccgtagaacgaaaccctaaacgttaccccagaaacctaccgacttagtacttacagaaccaaagtcgaactaggctagacgaccgacgaaccgacgacggtacctaattacttaccgagccggtaacggaaagtagttaacggaccggggtaccgaacgtaaccggggttcgaccgttaccggttcgttacctaggtactcccgg

SEQ ID NO: 373966 - DNA, 718 bp, Homo sapiens
  misc_feature: GZ8MTXP02FJFPK.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcgagtcgtgggggagcctggtacgaggccggggggtccctgagactctcctgtgtacgcctccggattcacctttagcagacatggcatgagcgtggggtccgccgaggctccgaggggaacggggccggaggtggggtgtcgaggtctaagtttaagtaggtaggtggtgtaagttaaggtaaacttttaaccaacaaccgaaggtaccgtccgggttagggaaacggggtccccgtactttacaaccctacttcctactaacggaagaacctaaacgttaccccaaagaaccaaactacttgtaaactcgtacgaacctaaaagtacgaacgtagggtacctaggaacgaccggaccgaaccggaaccaaccgggtacccttaaagttttaaacgtaaccgttcgggaccggtaaacgggtaaaaggttaacgtaaacggttaccgggggtaacaaaccggtaaacggggtacggttaccgtaacggttccgttttaacgtaacggaactttcccgg

SEQ ID NO: 373967 - DNA, 630 bp, Homo sapiens
  misc_feature: GZ8MTXP02GQPWM.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctaattttaaaacgtgtccagtgtgaggtgcagctggcggagtcgtgggggaggccgtggtacgacgggcccggggggtccctggacgactctccgtgtgtacgccgtccggtacttcctacctttagcagacagtggcatggacgtcgtcgggtcccgcgacggccgtaccggaaggggacggggccggtaggtgggtgtcgagtctagttagtagtagtggtagtaatagtaacttaccgaacacgagtacctccggtaggaaccgggtcccgtccttaccacctattcctgtaagacgaacctaactccccgaaagaaccactacgttagtactacgtacgaacaaagtcgaacgtaacggctaggacgaccgaccgacgacgacgacttatttatcgagacgacgaaagactacgtacggaccaacggtaacggtcgacgtacgtcgttacgacgtacgtccg

SEQ ID NO: 373968 - DNA, 708 bp, Homo sapiens
  misc_feature: GZ8MTXP02JNB2A.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagccgtggtacgagggccggggggtccctggacgactctcctgtgtacgcctcggattcaccttagcagacagtggcatgagcgtcgggtcccgccgaggcctaccggaaggggaacggggccggaggtggggtcgtacgagtcgaagttagtaggtaggtggtacgatagtaactttaccacaacgacgccgtcgggtaggaaacgggcccgacttaccgaacctattccctacgttaaacgaacgtaacctaaactttacccccgaaagtaaacccaacttaaccgttacggttaactaccgttaaacgaacctaaaacgttacggtaaaccgttaacgggccgttaaaggaacggaaccgaccccggaaacgaaccgaaccggtaccttaaagtttacttacgacgtaccggaacgtaaaggtacttaacgggtaccgggtaccaacggttaacggtcggtacttacggtccgtttacgtagacttccgg

SEQ ID NO: 373969 - DNA, 698 bp, Homo sapiens
  misc_feature: GZ8MTXP02JM21P.22.82.H05.1.454.CMB.2.raw
  modified_base (506)..(506): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaaacgtgtccagtgtgaggtgcagcgtggcggaggtcgtgggggaggccgtggtacgacgggccggggggtccctgacgactcctccgtgtgtagcctccggtattcaccttagctagacagtggcagtgagcgtcggggtacccgccgaggcctaccgggaagggggaacgggggccgggtaggtcggggtgtacgagttactagttagtaggtaggtggtagtagtaagtaacttacgacaacacgtacgtccgtaggacggggcccgtcttaccaacctattccgtataaacgacgtaaccaaacttaccccaaagaaacccactaaccgtntactcgtagactaaatggaacttacggggctacgaagacgaccggacgaaccgacgtaccgttaattaacgttaacgtcggaccggaacggtaaaggtacgttaacggggtaccgggttaccggaaacggtaaaccgggggttgtaacccggttacgggttaccgtttaacggtaacgggtactttacccgg

SEQ ID NO: 373970 - DNA, 649 bp, Homo sapiens
  misc_feature: GZ8MTXP02FVNV2.22.82.H05.1.454.CMB.2.raw
  modified_base (398)..(398): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcgttttctgtggctattttaaaacgtgtccagtgtgaggtgcagctggcggagtctgggggaggcctggtacaggccgggggggtccctggagactctcctgtgtagcctccggattcacctttagcagacatggcatgagctgggtcccgccaggctccgaggggaaggggccggaggtcggggtgtccgaggtcattaggtagtagtggtgacgtagaactttaccactacagtacgttcccgnggaaacggggcccgtcttaccacctatcctctaaggacaactaaacttcccaataaccacaactttagtactcgtacgaacgtaaagtacgaacgtaggacgtaggacgacggaccccggaacgaaccgaaccgtaccgttaacgtttagtaccgtaggaccggtacggtaaacggtaacgttacggtaaccggggtaccgaaaccggtaacgggtcggtaccgttaccggtcgtttaccgtagtacgtcg

SEQ ID NO: 373971 - DNA, 686 bp, Homo sapiens
  misc_feature: GZ8MTXP02F4044.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccggggggtcctggagactctcctgtgtacgcctccggattcacctttagcagacatggcatgagcgtcgggtccgccgaggcctccgaggggaacggggccggaggtgggtgtcgagtctagttagtagtagtggtagtataaggtaactttaccacgtaacgagtaccgtccgtaggaaacggggcccgtacttcaacccgtattacctacttaacggaacgtaactaaacttacccccaaaggtaacccaacgtaacgttacgtaaccttaccttaggaaccctaaaagttacggtaacgttacggggtacctaggaaacggtaccggacccgtaacggaacccgtaaccgggaccctaagttttaacgtacgtggaccgaacggtaaacggatttaacggacgggtacgaacgtaaccggtcgtaacgtacggtacgtttaccgagttacgtcg

SEQ ID NO: 373972 - DNA, 631 bp, Homo sapiens
  misc_feature: GZ8MTXP02H00DW.22.82.H05.1.454.CMB.2.raw
  modified_base (451)..(451): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcacatggagtttgggctgagctggtctttttcttgtggtctattttaaaacgtgtccagtgtgaggtgcagctggcggagtcgtgggggaggcctggtacgaggccggggggtccctgacgactctcctgtgtagcctccggattcacctttagcagacatggcatgagctgggtccgcaggctccgaggggaggggccggagtggggtgtgagtcagttagtagtaggtggtcgataagtaatttaccacacagctccggtagaaacggggccctcttacacctatctctaagacgaacaacttcccaagtaaccacactgttanactgacaaaattgaacgtacggctacggaagacgacccggtaacgaaccgtaaccgggcctaaagttttacttaaacgttcggaccggaaccgggaaaggtacttaacgggtaaccggggttcgaaccggtaaacgggttcgggacctttacggacgtttttaccgtaagtacgtaccgg

SEQ ID NO: 373973 - DNA, 674 bp, Homo sapiens
  misc_feature: GZ8MTXP02IL9HS.22.82.H05.1.454.CMB.2.raw
  modified_base (280)..(280): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggcttatttaaacgtgtccagtgtgaggtgcagctggcggagtcggtgggggagcctggtacgacgggcccggggggtccctggacgactctcctgtgtagcctcggattctaccttancagcatggcagtgagctgggcccacgaggcctaccggaggggaacggggccggaggtgggtgtacgagtctagttagtaggtaggtggtagtactagtaactttaccgaactacgagtaccgtccgtaggaaaccggggtccctacttaccgacctacttccgtacgtaacgaacgaacctaacttaccccgaaagaacccaactacttagtaactccgtagaaccaaaattcgactagggctagacgacgaccgaacgtacgaccggtaccttaaatttcgttaacgcggaccggacggtaaaaggtacttaaacgggtaacccggggttccgaaaacgtaacgggggtcgtaacccggttaacggtcccgttttagacgggtactttcccgg

SEQ ID NO: 373974 - DNA, 670 bp, Homo sapiens
  misc_feature: GZ8MTXP02I6D0H.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagcgtggcggagtcggtgggggacggcctggtacgacgggcccggggggtccctggacgacctctccgtggtgtacgcccgtccggtacttcaccctttagcagacatggacagtgagcgtgggtcccgccgaggccgtaccgaggggaaggggccggaggtggggtgtacgagtacagttagtagtagtggtagatagtaattaccacacagactcgagaacggccgtcttacacatctctagagacaacttacccgaaagaaccacacgtagtaatcttagacctaaaagtcgaacgtacggcgtagaacgacggacccggaacgaacgaaccgggtacccttaaatttaacttacgaggtaccgaaacgggaaaaggtacgttaaaaccggtaccggggacgtaaaacccggtaacgggggtacgtaaccggttaccggttccggtttaaacgtacgtaacgtttcccggg

SEQ ID NO: 373975 - DNA, 640 bp, Homo sapiens
  misc_feature: GZ8MTXP02JC2LA.22.82.H05.1.454.CMB.2.raw
  modified_base (346)..(346): a, c, t, g, unknown or other
  modified_base (634)..(634): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggcttaattttaaaacgtgtccagtgtgaggtgcagctggcggagtcgtgggggaggccgtggtacgacgggccgggggggtccctgagacctctcctgtgtacgcctcggtattcaccttagcagacatggcatgagcgtggtccgcaggcctaccgaggggaaggggccggaggtggggtntcgagtcgtagtttagtagtaggtggtagataagtaactttaccactaacacgtccgtccggtaggaaaccggggtccgccttacacctatctacgtaagaagtaaccaaattcccaaagtaaccacaacgttcgtaacttctacgtaaacaaagtacgtaccgtaagggccgtagaaacggacgacccggaacgaaccgacggtacctatttaactacgtcgcgaacggaaagtatacggtacggtacgacggtaaacggtcggtacgtacggtcgttacctaaggnttaccg

SEQ ID NO: 373976 - DNA, 696 bp, Homo sapiens
  misc_feature: GZ8MTXP02JHJFF.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggccgtggtacgaggccggggggtcctgagactctcctgtgtacgccgtcggtattctacttagcagacatggcagtgacgcgtcgggtcccgccgaggcctaccggagggggaacggggccggtaggtggggtgtcgtagtcgtagtttagtaggtagtggtacgaagttagtaaactttaccacaacacgtaccgtacccggtaggaaaccgggcccgtacttaccgaacctacgtccttacgtaaagaacgtaacctaaaccgttaccccgaaagtaaacccaacctacgttagtaacttcgtaaagacctaaaaagtcggaaaccgtaggtacgtacggaagaacccgaccggaaccgaccgaaccggtaccctaaagtttacttaacggtcgacggaacggtaaaggtacttaacgtaccgggtaccgaaacgtaaacgggtgtacccgtacgtcgtttacgaacggtattcccg

SEQ ID NO: 373977 - DNA, 634 bp, Homo sapiens
  misc_feature: GZ8MTXP02JUC73.22.82.H05.1.454.CMB.2.raw
  modified_base (229)..(229): a, c, t, g, unknown or other
  modified_base (244)..(244): a, c, t, g, unknown or other
  modified_base (281)..(281): a, c, t, g, unknown or other
  modified_base (283)..(283): a, c, t, g, unknown or other
  modified_base (285)..(286): a, c, t, g, unknown or other
  modified_base (288)..(290): a, c, t, g, unknown or other
  modified_base (292)..(292): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgtttctaggtggctaattttaaaacgtgtccagtgtgaggtgcagcgtggcggagtcgtgggggagccgtggtacgnggccggggggtcccngacgctctcctgtgtcgcctccgtattcaacctttgnananngnnngngcgtcggtccgcgcgcgcggacgggacgggcggtggtggtgtgtagtagtagtagtaggtagtggtagtataataactacacacgacgtcgtacgtacggacggtccgtctactactactactacgtagacgaactaactaaccaacaaccaactactacgtactactacgtaactaacgtacgtacgtacgtacgtacgacgaaccggaaccggaaccgaccgtaccgtaccgttacgtttacgttacgtacggacggtaacggtaacggtaacggtacggtaccggtaaccggaacggtaacggtacggtacgttacggttacgttacgtacgtacgtcg

SEQ ID NO: 373978 - DNA, 648 bp, Homo sapiens
  misc_feature: GZ8MTXP02JQ2B5.22.82.H05.1.454.CMB.2.raw
  modified_base (314)..(314): a, c, t, g, unknown or other
tcagacatacgcgtcacgaccggtgctcgatttagtcgagctctctcgcggggtctgagagaggagcccagccctgggattttcaggttgttttcatttggtgatcaggactgaacagagagaactcaccatggagtttgggctgagctggtcttttcttgtggcttaattttaaaacgtgtccagtgtgaggtgcagctggcggagtcgtgggggagccgtggtacgacgggcccggggggtccctggacgactctccgtgtgtacgcctccggattctacctttagcagacatggcatgagcgtgggtcccncgaggcctaccggaggggaacggggccggaggtggggtgtcaggtcagtttagtagtaggtgtagagtagtaatttaccacacgagacctccggtaggaacggggccctcttaccaaccgtattccgtacctaaaggacgaacctaaacttacccccgaaagtaaaccaacctactagttaactacgttcgaacctaaaagtcgtaaacgtacggacgtagacgacgaccgtaacgacgtaccgtactatttactacgcgacgaacggaagtacgtaacggtacgggtacgaacggtaacggtcgtacgtaccggttcgttactagtacgtacg

SEQ ID NO: 373979 - DNA, 651 bp, Homo sapiens
  misc_feature: GZ8MTXP02JDJ9D.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccgggggggtccctggacgactctcctgtgtagcctccggattcacctttagcagacatggcatgagcgtgggtcccgccgaggcctccgaggggaaggggccggtaggtggggtgtacgagtctagttagtagtaggtggtagtactagtaactttacccacaacgagtaccgtccgtaggaaacggggtccctcttaccgacctatccctagttaaagagaacctaacttcccccaagaaaccactaacctgtaactccgtagacctaaaattcgaactaacgggctaggaacgacgacccgacgtacaccggtacctaatttacgttacgacgcgaacgaaaaggttacgtaaacgttaccgggtacgaaacgtaaacggtcggtaaccttacccggtgttttaccaaagtcgttaccg

SEQ ID NO: 373980 - DNA, 631 bp, Homo sapiens
  misc_feature: GZ8MTXP02JS29Y.22.82.H05.1.454.CMB.2.raw
  modified_base (399)..(399): a, c, t, g, unknown or other
  modified_base (549)..(549): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggaggcctggtacgagggcccggggggtccctggagacctctcctgtgtacgccgtccggattcaccctttagcagacatggacagtgagcgtggggtcccgccgaggcctcccgaagggggaacggggccggaggtggggtgtcgagtcaattaggtagtaggtggtagatagtaatttaccanacgagacctccgtaggaacgggccgtacttcgacctatcctacgtaagacgaacctaaacttccccaaagaacctacgactgtaactctagacaaatcgaactagggctagacgacgcccggaacgacaccggtcctaatttacgttacnggaccgtaacggaaaggtataacggtaccggggtacaaacggtaacggggtgtaccgttacggtcgtttacgtaagcgtccg

SEQ ID NO: 373981 - DNA, 844 bp, Homo sapiens
  misc_feature: GZ8MTXP02GFAG9.22.82.H05.1.454.CMB.2.raw
  modified_base (240)..(240): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttggctgagctggtcttttctgtggctaattttaaaacgtgtcagtgtgaggtgcagcgtggcggagtcggtgggggacgcgtggtacgagggccgggggtccnggagctctctgtgtacgcctcggtattctaccttagcagacagtggcagtgacgtcgtcggtacccgcgaacggtccgtacccggaagggggaaacggggcccggggtaaggttcggggtacgtccggtaacgttaccgtaaggtttaaggtaaggttaggttaggggtacgtaaagttaaaggtaaacttttacccaaacgttaccgaaaggtacccgttcggtaaacggggtaaacccgggggtccgttaacctacccgaaccttactttaacccgtttacgtaaaacgggacctaaaaccgtaaacgtttaccccgaaaagtaaaccctaacttaaaccggtttgtaaaacttccggttaaaacgtaaaacgtaaacggtacggtaaacgtacggtaacggtaacgggaaaccggtaaccgggaacccggtaaaccggtaaacccggtaaccgttaaaaccgtttaacgtttaaaaccggtacggtaacgggtaaaccggtaaacggtaaaacggttaaacggtaaccggggttaaccggtaaccggtaaaacgggtaacggttacgtaccgttacggtacgttaacgtacggtacgtacg

SEQ ID NO: 373982 - DNA, 671 bp, Homo sapiens
  misc_feature: GZ8MTXP02GLLHJ.22.82.H05.1.454.CMB.2.raw
  modified_base (439)..(439): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttctgtggctattttaaaacgtgtccagtgtgaggtgcagctggcggagtcgtgggggaggccgtggtacaggccgggggggtccctgagactctcctgtgtagcctccggattcacctttagcagacatggcatgagctgggtccgccaggctcccgaggggaaggggccggagtggggtcgtgagtcagttagtagtaggtggtgatagtaattaccacacagactcgtagaacgggccgtcttacacccatctacgttaagacgaacaacttccccgaaaanaaccaactacgtataactctagaactaaagttcgtaacgtacgggacgtaggaacggaccgtacccggaaccgaaccggtaccggtaccgtttaacgtttaacgttaccggtacggtaccgggtaaacggtaaagggttaacgtaacggggttaaccggggtaacggtaaaccgggtaacgggttaccggtaccgttaccggttaccggttttacggtaacgttacgtaccg

SEQ ID NO: 373983 - DNA, 641 bp, Homo sapiens
  misc_feature: GZ8MTXP02J3CMF.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacagggccggggggtccctgacgactctcctgtgtacgcctccggattcacctttagcagacatggcatgagcgtcgggtccgccgacggctaccggaggggaacggggccggtaggtggggtgtcgagtcagttagtagtaggtggtgatagtaactttaccacacagccgtccgtaggaacgggcctcgttaccacctatcctactagacgaacaacttacccagaacactacgtagttactcgtacgaactaagtcgacgttacggacgttagaacgacggacccgaccgaacgaccggtactaaactttactttacgacggaccggtacggaaaggtacgttacgaacggggttccgaaacggtaaccggtacggtaccgtaccggttacgtttaccgtaaaggtacgtttcccg

SEQ ID NO: 373984 - DNA, 722 bp, Homo sapiens
  misc_feature: GZ8MTXP02HMUGL.22.82.H05.1.454.CMB.2.raw
  modified_base (354)..(354): a, c, t, g, unknown or other
  modified_base (398)..(398): a, c, t, g, unknown or other
  modified_base (403)..(403): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggagccgtggtacgacggccggggggtcctggagactctcctgtgtacgcctcggtacttcaccttagcagacagtggcagtgacgcgtcgggtccccgcgacggccgtccggaaggggacggggccggtaggtggggtntcgtagtctagttagtagtaggtggtagtataagtacttaccanacgancgtcgtaggacgggccctacgttaccactactctacgtaagacaactaacttacccgaaagaacctactaacgttctactacgagtaaactaaagttacgtaacgtacggtacgaaggaacggaccgtaacccggaaacgtaacccggtaaccgtttaacctttaaagttttaaccgttacggtaccgggtaaaccggaaacgggtaaaacggttaaacgttaaccgggggtaaccggggttaaaccgtaaaccgggttaacgggttccggtaaacccggtttaccggtttaccgtttaacgaacggtttaccgttccg

SEQ ID NO: 373985 - DNA, 613 bp, Homo sapiens
  misc_feature: GZ8MTXP02JYWVI.22.82.H05.1.454.CMB.2.raw
  modified_base (303)..(303): a, c, t, g, unknown or other
  modified_base (485)..(485): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtcttttcttgtggctattttaaaacgtgtccagtgtgaggtgcagctggcggagtcgtgggggaggcctggtacgaggccgggggggtccctgagactctcctgtgtagcctcggattcaccttagcagacatggcatgagcgtcgggtccnccgaggcctccggaggggaacggggccggaggtgggtgtcagtcagttagtagtagtggtgatagtaattaccacacagctcgtggaacggccgtcttacactatctctaagacgaactaacttacccagaaaccactaacttgtactcgtgaacaaattcgaacgttagggacctaggaanacggccgaacgacgaccggaccttaatttaactacgtcgacgacggtaaaggtacgttacgtaaccggggtccaaacggtaaccggggtcggtaccttacgggtacccgtttttacgaagtacgtccg

SEQ ID NO: 373986 - DNA, 696 bp, Homo sapiens
  misc_feature: GZ8MTXP02J0BTE.22.82.H05.1.454.CMB.2.raw
  modified_base (309)..(309): a, c, t, g, unknown or other
tcagacatacgcgtcacgaccggtgctcgatttagtcgagctctctcgcggggtctgagagaggagcccagccctgggattttcaggttgttttcatttggtgatcaggactgaacagagagaactcaccatggagtttggctgagcgtgtcttttctgtgctaattttaaaacgtgtccagtgtgaggtgcagctggcggagtcgtgggggagcctggtacgaggccgggggtcctgagactctctgtagtacgcctcggtattctacctttagcagacagtggcagtgagccgttgggcccgaccgnggactcccggaagggggaacggggccggaggtggggtcgtacgtagtcgtaagtttagtagttaggtggtagaacgtaggtaactttaaccgacaaccgtagaccgttaccgaggaaaccggggtcctcttaacccacctatacccttacgtaaacgaaccgtaaacctaaccttacccgaaacgtaaaccaaccgttaacttagtaccttacgtacgaaacctaaaagtcggaacgttacgaccggtaagaaccggtacggaaccccgaacggtaccgaacggttacttaacgtttactacgtacgacgaacggtaaaggtacgtacggaaccggtaacgaacggtaacggtcggtacgttacgttacgtttacgaacgttactcg

SEQ ID NO: 373987 - DNA, 708 bp, Homo sapiens
  misc_feature: GZ8MTXP02JR8I5.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagcctggtacgacgggccggggggtcctggagacctctcctgtgtagcctccggtattcacctttagcagacatggcatgagcgtcgggtcccgccaggcctaccggaggggaacggggcccggaggtggggtcgtcgtagtctaagttaggtagtaggtggtagaacgtagtaactttaccacaacacgaccgtccgtaggaacgggccgtacttacgaacctacgtcctacgaagtaacgaacctaaacgttaccccaaagaaaccctaacctaacgttacgttaaactccgttaacggaacctaaaaaggttacggaaccgttaagggaccgttacggaaaacggacccggacccggaaacggtaacccgaccgggtaaccccttaaagtttaacttaaaccggtcgacggaaaccggaaaaggtactaacggtaccgggtacgaaacgtaacgggtcgtacgttaccgtcgtttacgacgtactaccgg

SEQ ID NO: 373988 - DNA, 700 bp, Homo sapiens
  misc_feature: GZ8MTXP02I2GSY.22.82.H05.1.454.CMB.2.raw
  modified_base (325)..(325): a, c, t, g, unknown or other
  modified_base (685)..(685): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggacttaattttaaaacgtgtccagtgtgaggtgcagctggcggagttcgtgggggagcctggtacgagggcccggggggtcctgacgactctccgtgtgtacgcctccggtattcacctttagcacgtacagtggcagtgagtccgtcgggtccccgccgnggccgtaccggaagggggaacgggggaccggtagggttggggtcgttaccgtaggttactaagtttacgttaggtaggttggtacgaagttaaggtaactttacccaagtaacctacgtaccgttccgggaagggtaaaccgggtccccgtcttaaccgaccgttactacgttactaagaacgtaacctaaaccgttcccaaagaaccaactacttagtatccgtaagaacctaaaggtcgtaacagggtcgaacgacggaaccgccgaacggtaaccacggtccttaaatttacgtacgcggaccgtaacggaaaggtactttacggaccggtcgaaacgtcggtagtaccttacggtntttacgagtacgtcg

SEQ ID NO: 373989 - DNA, 737 bp, Homo sapiens
  misc_feature: GZ8MTXP02HPQXD.22.82.H05.1.454.CMB.2.raw
  modified_base (658)..(658): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggtcttaattttaaaacgtgtccagtgtgaggtgcagcgtggcggaggtcggtgggggaggccgtgggtacgacgggcccgggggggtccctggacgtactctccgtggtcgtacgcccgtccggtacttccacccttagcagacagtggcagtgagcgtcggggtccccgccgacggccgtccggaagggggaacgggggccggtagggtcggggtgtacgtaacggtctaagtttaggtaaggtagggtgggtacgtaagttaaagtaaactttaacccaacaacgaacggtaccgttccgggtaaggaaaccggggtccccgtacttacccgacctacgttcctacgtaaagaacgtaaacctaaaccgtttccccgaaaagtaaaccaacgtacttagtaaacttccgtacgaaactaaagttcgtaaccgtagggtctagaacggaccgaacccggaagaacccgaccggtccttaaaagtttaccgttacncggtacggaacggtaaagaacgttaccgggtacggtacgaacgtaacgggtgtacgtaccgtcgtttacgagtactccg

SEQ ID NO: 373990 - DNA, 635 bp, Homo sapiens
  misc_feature: GZ8MTXP02FNNAA.22.82.H05.1.454.CMB.2.raw
  modified_base (400)..(400): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggaggcctggtacacggccggggggtccctggagactctcctgtgtagcctccggattcacctttagcagacatggcatgagcgtcgggtccgccaggctccgaggggaaggggccggaggtgggtgtcgagtcattagtagtagtggtgatagaatttaccactacagctccgtggaacgggccncgttcaccatctctaagacgaacacttacccaagaaccacaacttgtaactcctagaccaaaatcggaactaaggctagaacggacgcccggaacgtacgaccggtacctaattttaaacgtacttacggacgtaacggtaaaggtacgttaacgggtaacccgggggtacgtaaacggtaaccgggggtcggtaccgttaaccggttcggtttttaccgaaaggtactttccgg

SEQ ID NO: 373991 - DNA, 598 bp, Homo sapiens
  misc_feature: GZ8MTXP02JLCLM.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagccgtggtacgagggccggggggtcctgagactctcctgtgtagcctcggattcacctttagcagacatggcatgagcgtgggtcccgccgaggctccgaggggaacggggccggaggtggggtgtcgagtctagttagtagtaggtggtagtatagtaatttaccgacacagcgtccgtaggaacgggcccgtacttacgacctatcctactaaggacgtaactaaacttcccgaaagtaaccactacttagtactctagaaactaaagtgtaaccgtaggctagagacggccgaacgacgacggacctattactactgcgacgaaaggactacgtacgggccgaacgtaacggtgtacgtacgtcgtttacgtagactcg

SEQ ID NO: 373992 - DNA, 547 bp, Homo sapiens
  misc_feature: GZ8MTXP02FRFBA.22.82.H05.1.454.CMB.2.raw
  modified_base (398)..(398): a, c, t, g, unknown or other
  modified_base (466)..(466): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacgaggccgggggggtccctgagactctcctgtgtagcctccggattcacctttagcagacatggcatgagctgggtccgccaggctccgaggggaaggggccggaggtggggtgtcgagtcagttagtagtagtggtgatagaatttaccacacagactccgtgaaacgggccncttcaccatctctagacgacaacttcccagaaccacactagtatctagacaaatgactaggctagagngccgacgacgacggaccatttatactgcgacgaaaggatacgtacggcaacgaacggtcgactacgcgtttacagtactcg

SEQ ID NO: 373993 - DNA, 824 bp, Homo sapiens
  misc_feature: GZ8MTXP02I2AHA.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaacgtgtccagtgtgaggtgcagctggcggagtcgtgggggaggcctggtacaggccggggggtccctggagactctcctgtgtagcctccggattcacctttagcagacatggcatgagcgtgggtccgccgaggcctccgaggggaacggggccggaggtggggtgtcgtagtctagttagtaggtagtggtagtatagtaatttaccacacacgacctccggtaggaaacggggtccgtccgtttacaaccgtaattccctacgttacggaacgtaaacctaaactttacccccaaaggtaaacccaaccgtaacttacggttaaactccttacggaaacctaaaaagttacggtaaaccgttaacgggggtaccttaagggaaacgggtaaccgggacccccgggaaaaccgggaaaaccccggtaacccgggggtaacccccgtttaaaattttttaaaacgtttaacccggttacgggggaacccggtaaacccggggtaaaaacgggttaaaagtttaacccggggtttaaaacccggggggttacccgtaaaaccgggttaaaacccggggggtttcggaaaccccggtttaacccgggttacccgggtttttaccgtaaacggggttaaacgttttccccgggg

SEQ ID NO: 373994 - DNA, 864 bp, Homo sapiens
  misc_feature: GZ8MTXP02HA9SY.22.82.H05.1.454.CMB.2.raw
tcagacatacgcgtcacgaccggtgctcgatttagtcgagctctctcgcgggtctgagagaggagcccagccctgggattttcaggtgttttcatttggtgatcaggactgaacagagagaactcaccatggagtttggctgagcgtggtctttttcttgtggcttaattttaaaacgtgtccagtgtgaggtgcagcgtggcggagtcgtgggggaggccgtggtacgacggcccgggggtcctgagactctcctgtgtagcctcggattcacctttagcagacatggcagtgacgcgtcggggtcccgccgacgggccttacccggaaggggaaacggggcccggaaggttcggggtcgttaccgaggttcctagtttaaggttaggtaaggttgggtaagtaagttaaggtaaacttttaacccaacgaaaccgtaacgtaccgttacccggtagggaaaccggggtccccgtacctttaccgaacccctattacccgttacgtaaacggtaaacgtaacccgtaaaacctttaccccccgaaaaggtaaaccccaaccgtaaccgtttacggtaaacttaccgttaacgtaaaccgttaaaaacgttacgggtaaaccgtttaaacgggcccgtttaagggaaaccgggaaccggaacccccgggttaaccggaaaccgtaaccccggggttaccctttaaaacgtttttaaccgtttaaaaccgtcgggaacccggtaaaccggtaaaagggtaacgttaaacgggtttaaacccgggggtaccgtaaaaccgggtaaaccggggttcggtaaacccgttacccgggttccgtttaaccgtaaggtaccgtttacccgg

SEQ ID NO: 373995 - DNA, 657 bp, Homo sapiens
  misc_feature: GZ8MTXP02HTL9F.22.82.H05.1.454.CMB.2.raw
  modified_base (380)..(380): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttttcttgtggctattttaaaacgtgtccagtgtgaggtgcagctggcggagtcgtgggggagcctggtacaggccggggggtcctgagactctcctgtgtagcctccggtattcacctttagcagacatggcatgagcgtggtccgccgaggccgtccgaggggaaggggccggagtggggtgtcgagtcagttagtagtaggtcgtgattaagtaatttaccgntaacagccgttccgtaggaacgggtccctacttcgaccctatcctacgtacgaacgaacctaaacgtttacccccgaaaagaaccctactaacgtacgttacttaccgtagtaacctaaagttcgtaaacgtaggacgtacgaacgaccggaccgtaacgaccgtaccgtactttaagtttacgtacgtcggaaccgaacggtaaaggtacgttaacggtaccgggtacgaacggtaaccggtcggtaccgttacggtacgtttacgtacgtatccg

SEQ ID NO: 373996 - DNA, 591 bp, Homo sapiens
  misc_feature: GZ8MTXP02H2BAK.22.82.H05.1.454.CMB.2.raw
  modified_base (280)..(280): a, c, t, g, unknown or other
  modified_base (283)..(283): a, c, t, g, unknown or other
  modified_base (285)..(287): a, c, t, g, unknown or other
  modified_base (289)..(289): a, c, t, g, unknown or other
  modified_base (320)..(320): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtgtcgttttctaggtggctatttaaaacgtgtcagtgtgaggtgcagctggcggagtcgtgggggaggcctggtacgaggccgggggggtcctgagactctcctagtgtagcctcggattcaccttgcaganagngnnngngcgtcggcgcgcgcgcggacggacgggcggnggtggtgtgtagtagtagtagtagtaggtagtagtagtacgtaactacacacgacgtcgtacggtacggtacggccgtacctacactactactacgtagacgaactaactaccaacgaaacactacgtacgtactactactaactaaacgtagtaacgtacgtacgagacgacgacgacgacgacgtactacttacgtacgtacgacgacgaacgtaacgtacgtacggacgacgtaacgtacgtacgtacgtacgtacgtacgtacgtcg

SEQ ID NO: 373997 - DNA, 657 bp, Homo sapiens
  misc_feature: GZ8MTXP02IBJS1.22.82.H05.1.454.CMB.2.raw
  modified_base (405)..(405): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggcttatttaaaacgtgtccagtgtgaggtgcagctgggcggagtcgtgggggaggccgtggtacgaggccggggggtccctgagactctcctgtgtagcctccggattcacctttagcagacatggcatgagcgtgggtccgccgaggctccgaggggaacggggccggagtggggtgtcgagtcattagtagtagtggtgatagtaaatttaccactacagactccgtagaaacgggggccncgtttcaccgtacttctcgtagacgtaacaaacttccccgaaagaaaccaactaccttaggttactacgtacgaacctaaaatcggtaacgtagggtacctaggaaacggacggacccggaacgaaccgaccggaccttaagtttattaacccgtgaccggtacgaaacggtagttacgtaaccggggttcgaaaccgaacggggttacgggaccgtttaaccggccgttttacgtaacggtacgttcccgg

SEQ ID NO: 373998 - DNA, 689 bp, Homo sapiens
  misc_feature: GZ8MTXP02JDUUS.22.82.H05.1.454.CMB.2.raw
  modified_base (507)..(507): a, c, t, g, unknown or other
tcagacatacgcgtcacgaccggtgctcgatttagtcgagctctctcgcgggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggaggccgtggtacgaggccgggggtcctgagctctcctgtgtagcctcggtattcaccttagcagacagtggcatgagtcgtcgggtcccgccgaggcctccggaaggggaaggggcccggaggtggggtgtcgaggtctagttagtagtaggttggtagtagtaagtaactttaccactaacgaacgtaccgtccggtacggaacggggtcccctaccgttcaacctacttccgtaccgtaaaggtacaaactaacttcccccgaaagtaaccctaaacaccttagttaacncgtacgaactaaagtcgtaacgtaggacgtagaacgacgaccgtaaccgaccgaccggtacttaagtttacgtacgtacggaccggtaaacgggtaaaagtacgttaacgggtaccgggtacgaaaccggtaacggggttcgtaacccgttaccgggttacgtttaaccgtacggtactacg

SEQ ID NO: 373999 - DNA, 706 bp, Homo sapiens
  misc_feature: GZ8MTXP02FWCZE.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacagggccggggggtcctgagactctcctgtgtacgcctccggtattctacctttagcagacagtggcagtgaggcgtcggggtcccgccgaggccgtcccggaagggggaacgggggcccgggaaggttcggggtgtccgaggtactaagtttaggtaggttaggtggtagtaataagtaaatttacccacacagtaccgtccggaggaaacgggcccgtctttaccgaccctattcctacgtaagacgaaacctaaacttaccccgaaagaaccctaacctacttacggttaacttccgtaacggtaaacctaaaagttccgtaacgttaacgggtccgtaaggaaacggacggacccggaacgaacgacccgggtaccttaagttttactacgtggaccggaacggtaaaggtaacttacgggtaccgggtacgaaacgaaccggggttcgaccgttacggtcgtttacgacgtattccg

SEQ ID NO: 374000 - DNA, 630 bp, Homo sapiens
  misc_feature: GZ8MTXP02H916K.22.82.H05.1.454.CMB.2.raw
  modified_base (555)..(555): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctaattttaaaacgtgtccagtgtgaggtgcagctggcggagtcgtgggggaggcctggtacgaggcccggggggtccctgagacctctcctgtgtacgcctccggtattcacctttagcagacatggcatgacgcgtcggggtcccgccgaggccgtacccggagggggaacgggggcccggagggttggggtcgtcgaggtacagtttacgtaggtaggtggtagattagtaactttaccacacacgtcgtacgtaggaaacggggccctcgttacaccgtattctactaagacgtaactaacttacccaagaaccactacgtagtatctagaccaaagtacgtacgtaggctagacgacgaccgacgacgaccgactatttacttacngtacgacggtaaagacgtacgtaccgggtcgaacggtaacggtcggtacgtaccggttcgtttactagacgtccg

SEQ ID NO: 374001 - DNA, 671 bp, Homo sapiens
  misc_feature: GZ8MTXP02JCC1P.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagccgtggtacgaggccgggggtcctgagactctcctgtgtagcctcggattcacttagcagacagtggcagtgagcgtcgggtcccgcgacggctccggaaggggaacggggccggaggtggggtcgtcgagtctagtttaggtagtaggtggtagtaagtaacgtaaactttaccaacaacgaagtaccgtccggtaggaaacggggtcccgtacttaccaacctacttaccgtacgttaaaggaacgaacgtaaactttccccgaaataaccaactacctagtactccgtagaacctaaagtacgtaacgtacggacctaggaacgcgggaacccgaacggaacaccggaaccttagtttaactaccggtgaccggaacgaaagtacgtacgtaccggggtaacaaccgtaagggtcggtacgtacggttacgtttacgtacgtacgtttccg

SEQ ID NO: 374002 - DNA, 728 bp, Homo sapiens
  misc_feature: GZ8MTXP02IL5DP.22.82.H05.1.454.CMB.2.raw
tcagacatacgcgtcacgaccggtgctcgatttagtcgagctctctcgcggggtctgagagaggagcccagccctgggatttttcaggtgttttcatttggtgatcaggactgaacagagagaactcaccatggagtttgggctgagctggtcttttcttgtggcttatttaaacgtgtccagtgtgaggtgcagctggcggagtcgtgggggaggcgtggtacgaggccggggggtccctgagactctcctgtgtagccgtccggtattcacttagcagacatggcatgagcgtcgggtccccgccgaggcctaccggaaggggaacggggccggtaggtggggtgtcgagttctagttaggtagtaggttggtagtagtaagtaactttaccgacacacgtaccgttccgtaggaacggggcccctaccgttccaacctacgttacctacgttaacgaacgtaacttaaaccttaccccgaaacgtaaaccctaactacgtttaacgtactaccgtagtaaacccgtaaaattaccggtaacgtttacgggacggttaggaaaccgacggaccccggaaccggtaaacccgaccggttaacccttaagtttttaacttacgtacggtaccggaacggtaaaacgggtagtacggttaaaccggggtacgtaaccggtaacgggtcggtaccgttacggttaccgtttacggtacgtacgttaccgg

SEQ ID NO: 374003 - DNA, 744 bp, Homo sapiens
  misc_feature: GZ8MTXP02HYRO9.22.82.H05.1.454.CMB.2.raw
  modified_base (283)..(283): a, c, t, g, unknown or other
  modified_base (304)..(304): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagccgtggtacgaggccggggggtcctggagctctcctgtgtagccgtcggacttcacttagcagacntggcagtgagcgtgggtcccncgaggcctccggaaggggaacggggccgaggtgggtgtcagtcagttagtagtggtgtgatagtatttaccatacgaagtcgtccgtagaacggggccctacgttaccaacctatccgttacaagtacgaacttaaacgttccccaaagaacctaacacgttagtactttactacgaaacgaaaactttcggtaaacgttaaacgggtacgtaacggaaacggaccggtaaccggaaacccggtaaccggtaaacccgttaacctttaaagttttaaaccgttaaccggtaccgggtacgggtaaaaccggtaaaagggttaaaccgtttaaacggggtaaacccggggtaaaaccggtaaaccgggttaaaaccggggttcgggttaaccccgtttaaccggggttaccgtttttaccgtaaacgttaccggtaaccgg

SEQ ID NO: 374004 - DNA, 601 bp, Homo sapiens
  misc_feature: GZ8MTXP02I1O3S.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaaacgtgtccagtgtgaggtgcagctggcggagtcgtgggggaggcctggtacaggccggggggtccctgagactctcctgtgtagcctccggattcacctttagcagacatggcatgagcgtggggtcccgccgaggcctccgaggggaacgggggcccggaggtgggtgtaccgagttcgtagtttagtagtaggtggtagatagtaactttaccacaacagctccggtaggaaacgggcccgtacttcgacctagttcctctaaggacaaactacttacccgaagaccaactacttagacttctagacaaaagtgaactagggctagacgacgcgacgacacgtactagtttactacgtgacgacgaaaggtactacgtaacggggtcaacgaacggtggaccttacgtccgtttacaacgtactcg

SEQ ID NO: 374005 - DNA, 675 bp, Homo sapiens
  misc_feature: GZ8MTXP02IE1MY.22.82.H05.1.454.CMB.2.raw
  modified_base (341)..(341): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagcgtgggcggagtcgtgggggaggccgtggtacgagggcccggggggtcctggacgactctcctgtgtacgcctccggattcactttagcagacatggcatgagcgttggcccgcaggcgtcgaggggaaggggccgaggtggtntcgagtcagttagtagtagtggtacaagttagtaaactttaccacaacagtaccgttccggtaggaaaccgggggtccctaccttaccgaacctacttaccttcgtaagaacgtaaacctaaaccgttaccccgaaagaaacctaactaaccgttaggtactacgtacgtaaacctaaaaagttcggtaaacgtacggacgttagggaacgaccggacccggaaacgaacccgtcggaccttaagtttaacttaccgtgacggtacgaaagtaagtaccggtacgggttcaacggtaacggtcgtaccttacggtaccgtttcaggtacttccg

SEQ ID NO: 374006 - DNA, 688 bp, Homo sapiens
  misc_feature: GZ8MTXP02GNQHT.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggcctggtacgagggccggggggtccctggagactctcctgtgtagccctcggacttctacctttgcagacatggcatgagcgtcgggtcccgccaggccgtaccggaggggaacgggggcccggaggttggggtgtccgtaggtactagttaaggtaggtaggttggtacgtataagtaaactttaccacaacgacgtaccgtccgtaggaaccgggtcccgtcttaccaccctactctcgtaaagacgaacctaaacttccccaaagaaccctacgacttagtactacgtgaactaaagtcgtaacgtaagggcctaggaacgaccggccgaacgtaaccgaccggtacctaagttttaacgtaacgtcggaccgaacggaaaggtacgtaaacggtacccggggtaacgaaacggtaaaccgggttcgggtaaccttaacgggttcccgtttagtaacggtacgttccg

SEQ ID NO: 374007 - DNA, 598 bp, Homo sapiens
  misc_feature: GZ8MTXP02G2B97.22.82.H05.1.454.CMB.2.raw
  modified_base (460)..(460): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttcttgtggctattttaaaacgtgtccagtgtgaggtgcagctggcggagtcgtgggggaggcctggtacaggccgggggggtccctgagactctcctgtgtagcctcggattcacctttagcagacatggcatgagcgtgggcccgcgaggcctccggaggggaacggggccggaggtgggtgtcgagtcgtattaggtagtaggtggtgatagtaactttaccactacagcctccggtagaacggggcctcttcaccatctacgtagagaactaacttcccaagaacactactagtatccttaanactaaagtcgtaacgtggacgtagacggacgaccgaacgacgtaccgtactattactacgacgacgtaacggaagtacgtaacggaccgggtacgaacggtaacggtcgtaccgtacgttacgttactacgtacgtcg

SEQ ID NO: 374008 - DNA, 566 bp, Homo sapiens
  misc_feature: GZ8MTXP02FE6FO.22.82.H05.1.454.CMB.2.raw
  modified_base (360)..(360): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgagtgcagctggcggagtcgtgggggaggcctggtacaggccgggggggtccctgagactctcctgtgtagcctccggattcacctttagcagacatgggcatgagcgtggggtccgccaggctccgaggggaaggggccggaggtggggtgtcagtctattagagtagtggngataagaatttaccacacagctccgagaacgggccgcttcaccatctctagagacaacttcccagaaacacatgtatctagacaaaatgaacgtaggtactagaacgacggacccgaacgacgaaccggcctaatttaattaactgacgacgaaaggataacgtacggggcaacgaacggtggaccgtacgtcgtttacagactcg

SEQ ID NO: 374009 - DNA, 691 bp, Homo sapiens
  misc_feature: GZ8MTXP02JXME0.22.82.H05.1.454.CMB.2.raw
  modified_base (535)..(535): a, c, t, g, unknown or other
  modified_base (551)..(551): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctaattttaaaacgtgtccagtgtgaggtgcagcgtggcggagtcggtgggggacggccgtggtacgacgggccgggggtcctgagactctccgtgtgtacgccgtccgtacttctacctttagcagactagtcggcagtgagcggtcgggtcccgccgacggcgtaccggaggggaacggggccggtagggtaggggtctcgtaacggtacgtaaagttaggtaaggtaggtagggtacgtaaagtaagtaaacgtttaccaaccaacgtacgtacccgtccgggtacggaacggggccctccttaccgaacctctacgtacgtaagacgtaactactaaccctaagaacctactactagtactcgtaanactaaagcgagtacgngagaggaacggtcgaaccgacacggtctaatttacgtacgtacggaccgaacgtaaaggtacggtaaccggaccgggttaaccgaacggggtaacggtaacggtccggttaaccgttacgtttacgtaacgacgtttccg

SEQ ID NO: 374010 - DNA, 751 bp, Homo sapiens
  misc_feature: GZ8MTXP02HQTTU.22.82.H05.1.454.CMB.2.raw
  modified_base (284)..(284): a, c, t, g, unknown or other
  modified_base (542)..(542): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaacgtgtccagtgtgaggtgcagctgggcggagtcgtgggggaggccgtggtacgagggcccggggggttcctggacgactctcctgtgtacgcctccggtattcaccttancagacatggcagtgagcgtcgggtcccgccgacggcctccggaggggaacgggggccggaggtggggtcgtacgtacggtcttaagttagttaggtaggttggtagtaagttaagtaactttaaccactaaccaggtacccgtcgggttaacgggaacggggtccccctacttacccaacctacttaccctacgttaacgaaacgtaaccctaaacttcccccgaaaagtaaacctaccagttactacttaccggtanaaaccgtaaagtacggtaaccgtagggtaccgaggaacggaaccggacccggtaacggaaccctacccgggtactttaactttaacgttaccgttacggaccggtaaacggggtaaaggtacgttaaacgggtacggggtaacccgtaaaccggggaaacgggtttccggacgttaccggggttaccttttaggtaacgtacgttcccg

SEQ ID NO: 374011 - DNA, 783 bp, Homo sapiens
  misc_feature: GZ8MTXP02II27S.22.82.H05.1.454.CMB.2.raw
  modified_base (191)..(191): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcacatggagtttgggctgagctggtcttttcttgtggcttatttaaaacgtgtccagtgtgaggtncagctgggcggagtcgtgggggagctggacgacggccgggggtcctgacgactcgtcctgtgtacgcctacggattctacttagcagactagtggcagtggagccgtgggcccgcgacggccgtaccggaaggggaacggggccggtaggtcggggtcgacgtacggtactaagtttaacggtaggttaaggtgggtagtaagttaacggttaaaactttacccgaacgtaacaacggtaccgtccgggtaagggtaacgggggtcccctaccgttaccgaaccctacgttccgtacgtaaggaacgaaccttaaacgttaccccgaaaagtaaccctaaaccgtacgtacgtaactacgttacgaaaccgtaaaagtcggtaaaccgttgggaccgttaaggaacggtacggaacccggtaacggaaccgacggtaaaccttaacgttttacgttaaccggtacggaacccggaaacgggttaaaggtaaacgttaaccggggtaaccggggtaaccggtaaaaccgggttaaacggggttcccggtaacggtttaacgggtacccgttttacgtaacggacgtttaccgg

SEQ ID NO: 374012 - DNA, 733 bp, Homo sapiens
  misc_feature: GZ8MTXP02HL844.22.82.H05.1.454.CMB.2.raw
tcagacatacgcgtcacgaccggtgctcgatttagtcgagctctctcgcggggtctgagagaggagcccagccctgggtattttcaggttgttttcatttggtgatcaggactgaacagagagaactcaccatggagttgggctgagctggtctttttcttgtggtacttaattttaaacgtgtccagtgtgaggtgcagctgggcggaggtcggtgggggacggccgtggtacgacggggcccggggggttccctggacgacttccgtccgtggtgtacgcccgtccggtacttctacctttagcgtaagacagtggacagtgaggcgtaccggggtccaccggaggccgtaccggaagggggacggggccgggtagggtggggtcgtcgagtacgtaagtttaaggtaggtggttaggtacgtaagtaagtaacctttacacaacgtacgtccgtaccggaaggaccggtcccgtacgtaccacctactaccttagaacgaacgtaactaaaccttacccgaaacgaacctaactacgttatacttcgtacgaaacctaaagtacggtacgtacggacgtacggaacgaccggacccgtaacgaaccgtacccgtacgtttaactttaccttagcggtaccggtaacggaaaggtaactacgggtaacggttaccgaacgggtaaacgggtcggtaaccgtacggttacgtttacgtaacggtcttaccgg

SEQ ID NO: 374013 - DNA, 663 bp, Homo sapiens
  misc_feature: GZ8MTXP02JAPLU.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttctgtggctatttaaacgtgtccagtgtgaggtgcagctggcggagtcgtgggggaggcctgggtacgacgggccgggggggtccctggacgactctcctgtgtacgccgtccggattcacttagcagacatggcatgagcgtcgggtcccgccgaggccgtaccggagggggaacggggccggaggtggggtgtccgaggtcaagttagtaggtaggtgggtacgaagttaagtaaactttaccgaactaacgaacgtacctccgggtacgggaaacgggggtcccgtacttacccaacctattacccgttactaacggaacgtaaacctaaacttaccccaaaggaaaccactaacgttgtaatccgttagaaactaaagtacgtaacaggctagacgacgccgaacgacacggacctaatttactacgtcgaccgaggtaaacgtacgtaacgtaccggggacgtaacgaaccgggtgacctacggtcgtttaccagtacgtccg

SEQ ID NO: 374014 - DNA, 790 bp, Homo sapiens
  misc_feature: GZ8MTXP02IZKAZ.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggtctaattttaaaacgtgtccagtgtgaggtgcagctggcggagtcgtgggggaggcctggtacgaggccggggggtcctgagactctcctgtgtagcctccggattcacctttagcagacatggcaagtgacgcgtggggtaccccgccgacgggccttcccggaaagggggaaacgggggccccggtaagggtcgggggttcgtacgtagtactaagtttaagttaggtaggtaggtacgtaagtaagtaaacttaccgaaacaacgtaacgtaccgttccgggtaacggaaccgggtcccgtaccttacccgaaacttacgttctaacgtaaaggaacgtaaacctaaaccttaacccgaaaagaaacctaacctaacgttacgtataccgtagtaaactaaaacgttagtaacgtacgggacgtaaggaaaccggtaccgaacccggaaaccggtaaaccgtaaccggttaactttaaaacgttttaactaaacggtacggtaaccggaaacggtaaaaggtaaacgtttaaccgggtaaaccggggtaaccgtaaaacgggtaaacccggggttacggtaacctttaacccgggttacgtttttaacgaacggttacgttcg

SEQ ID NO: 374015 - DNA, 612 bp, Homo sapiens
  misc_feature: GZ8MTXP02IIHN4.22.82.H05.1.454.CMB.2.raw
  modified_base (459)..(459): a, c, t, g, unknown or other
  modified_base (541)..(541): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctattttaaaacgtgtccagtgtgaggtgcagctggcggagtcgtgggggaggcctggtacgaggccgggggggtccctgagactctcctgtgtagcctccggattcacctttagcagacatggcatgagcgtgggtcccgccgaggcgtccgaggggaacggggccggaggtggggtgtcgagtcgattagtagtaggtggtacgatagtaactttaccactacacgaccgtaccgtaggaacgggccgtacttaccacctactccgtactaagaagtaactaacttacccaaanaaccacacttataactcgtaagacaaaattcgaactacgggctagagacggaccgacgacgaccggtactatttacttacgngacgacggaaagtacgtacgtaacgggtcgaaccgaaggtcggtacgtacggtacgtttacgacgtagtcg

SEQ ID NO: 374016 - DNA, 761 bp, Homo sapiens
  misc_feature: GZ8MTXP02I4HF8.22.82.H05.1.454.CMB.2.raw
  modified_base (308)..(308): a, c, t, g, unknown or other
  modified_base (315)..(315): a, c, t, g, unknown or other
  modified_base (318)..(318): a, c, t, g, unknown or other
  modified_base (376)..(376): a, c, t, g, unknown or other
tcagacatacgcgtcacgaccggtgctcgatttagtcgagctctctcgcggggtctgagagaggagcccagccctgggtatttttcaggttgtttttcattttggtgatcaggactgaacagagagaactcaccatggagtttgggctgagcgtggtcttttcttgtggcttaattttaaacgtgtccagtgtgaggtgcagcgtggcggaggtcgtgggggagcctgggtaccgacgggcccggggggtccctggacgacttccttccgtggttcgtacgcccgtcccgggtattctacctttaggnaacgtanagngcagtgacgcgtcggacccgcgaggtccgacgggaggggacggggcggtagggttggngtacgtacgtactaggttaagtacggtaggtggtaagtaacgtaaagttaacctaaccacgaaccgtacggtaccgtcgggtaggaaccggtccctacctaccaacttactacgtaacgtaaacgaacgtaacctaaacgtaacccgaaataaaccctaactaaccgttacgtaaccttacgttaaacgaaaacctaaaggtaacggttaacggacggtacgtaaggaaccgaaccggtaacccggaacggaaccggtaacgtaacctttaacgtttacgttaaaccggaggtaacggaaacgtaaaggttaaacgttacggaccggggtacaaacgggtaacggtacggtaccgttacggtaacgtttacgaaggtctttaccg

SEQ ID NO: 374017 - DNA, 671 bp, Homo sapiens
  misc_feature: GZ8MTXP02JB2IM.22.82.H05.1.454.CMB.2.raw
  modified_base (495)..(495): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagcgtggtctttttcttgtggcttaattttaaaacgtgtccagtgtgaggtgcagctggcggaggtcgtgggggaggccgtggtacgacgggcccgggggggtccctggacgactctcctgtcgtagcctccggattctacctttagcagacagtggacaatggacgcgtcggggtcccgccgaggccgtaccgaggggaacggggcccggaggtgggtggtaccgaggttctaaagttagtaggtaggttggtagtagtaacgtaacttttaaccgactaacaacgtcgtaccggtaggaaccggggccgtccttacgacctaactctactagaacgactactacccganaacacgactagtatactagactaaatgacctaggctagacgacgaccgacgacgacgacctagtttaacttacgtagaccggacggaaagtaaacggtacgttaaccgggggttaccgaaacggtaaccggggtcggtacgttaccggttccggtttataaccggtaagtttcccg

SEQ ID NO: 374018 - DNA, 642 bp, Homo sapiens
  misc_feature: GZ8MTXP02JSGDE.22.82.H05.1.454.CMB.2.raw
  modified_base (290)..(290): a, c, t, g, unknown or other
  modified_base (630)..(630): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggctaattttaaaacgtgtccagtgtgaggtgcagctggcggagtcgtgggggagcctggtacaggccggggggtccctgagactctcctgtgtagcctcggacttcacttagcagacatggcatggancgtggtcccgccgaggctaccgaggggagggccggagtgggtagccgtagtcagttagtagtaggtggtgagtagaactttaccatacagtccgtaccggtaggaacggggcctacgtaccacctagtcctacgtaagacgtaactaacgttcccaaagtacccactaacttgtagtacctagtaactaaagtcgaaacgtaagggctagggacacggacccgttacgaaccgacggtaacctagttttaacgtaccgttcggaggtaaccggtaaatacggttaaaccgtacggggttacaacggtaacgggcgttaaccgttacggtcgttttaaccnggttaactcccg

SEQ ID NO: 374019 - DNA, 684 bp, Homo sapiens
  misc_feature: GZ8MTXP02JAKVG.22.82.H05.1.454.CMB.2.raw
  modified_base (652)..(652): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggagcctggtacgaggcccgggggtcctgagactctcctgtgtacgcccgtcggtattcctacttacgcagacagtggcagtgacgtcgtcggtcccgccgaggccgtacggaaggggaacggggccggaggtgggtcgtcgagtctaagttagtaggtggtggtacgagttaacgtaactttaaccactacgacgtccgtccggtaggaaccggggtcctacgttaccaccgtacttccgtagtaacggaacaaacctaacgttacccaaagaaccaactacgttagtactcgtagaacctaaaagtcgtaacgtaggtacgtaggaaccgagaacccccggaagtaaccgacccggtactttaaacgttacttaccggtacggaccgtaaaggtaaaccggtagttaaccggtaacggtaccgaaacgtaacgggngtacccgtacggttacgtttacgaagtcttcg

SEQ ID NO: 374020 - DNA, 869 bp, Homo sapiens
  misc_feature: GZ8MTXP02HJWLI.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggtcttaattttaaaacgtgtccagtgtgaggtgcagctggcggagtcgtgggggagcctggtacgaggccggggggtcctgagactctcctgtgtacgcctcggattcacttagcagacatggacatgagcgtcgggtcccgcgaggcgtccggaaggggaacggggaccggtaggtggggtgtacgacggtcgtaaagtttaagtaaggtaggttagggtacgtaaagttaaacgtaaactttaacccaactaacgaacggtaccgttcccgggtaaggaaacgggggtccccaccgtttaccaaaccctaacgttaccctacgttaaaggtaaacgaaacctaaaaccgtttacccccaaaaggttaaaacccgaaaccgtaaccttaaggttaacttaccctaagggttaaaccaaaaaacgttggtaaaacccgttaacggggtacgtaaacgggaaagggtaacccggaacccggtaaaacccggaaacccggttaaaccccgggtaaccccgtttaaaagtttttaaaacccctttaaaggtcccgggaaacccgggtaaaacggaaaaacgggggttaacttaaaaccggggttaaaaccgggggttacccggtaaaaaccggaaaaccccgggggttggttaaccggttaaccccgggtttaaccggtttttacccgtaaaagggtacctttaccggg

SEQ ID NO: 374021 - DNA, 675 bp, Homo sapiens
  misc_feature: GZ8MTXP02IP83X.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagcctggtacgaggccggggggtcctgagactctcctgtgtacgcctcggacttctacctttagcagacagtggcatgacgcgtcggggtcccgcgacggcgtccggaagggggacgggggcccggaggtggggtgtcgtagtactagttaagtaggtaggtggtagaagtagtaactttaccacacacgtccgtcgtacggaacggggccgtccttacgacctacgtccttacgtagaacgtaactaaccttacccgaaacgtaaaccaaaccgttactacgttactacgttacgaacgtaaaaattcggtaaacgtacggtacctaggacgaccggacccgacgaaccgtaccggtaccttatttaacgttacgacggtacggacgaaaaggtacgttaacgacggggtacgaacgaacgggtcggtcgtacggtacgtttacgtacgtacgttaccg

SEQ ID NO: 374022 - DNA, 710 bp, Homo sapiens
  misc_feature: GZ8MTXP02FT3AD.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagcgtggcggagtcgtgggggaggccgtggtacgacgggccggggggtccctggagactcgtcctgtgtacgcctccggattcaccttagcagacatggcatgagcgtcgggtccgccgaggcctaccggaaggggaacgggggcccggtaggtggggtcgtaccgtagttaccgtagtttaaggtaggtaggttgggtagtaacgttagtaaactttaccgacaaccgagtaccgtcccggaggaaaccgggtcccgtcttaccgaccctagttccctacgttaaagaacgtaaacctaaacgttaccccgaaacggaaacctaaccgtaacgttacgtaaacttccgtaggtaaaccctaaaagttcgaaaccgttaggacgttacgacgaaccggacccgaacgtaacaccggtacctagtttactacgtgaccggacgaaaggtactacggtacgggtacgaaacggtaacgggtcggaccgttacggtacgtttacgacgtactaccgg

SEQ ID NO: 374023 - DNA, 629 bp, Homo sapiens
  misc_feature: GZ8MTXP02HD5Q4.22.82.H05.1.454.CMB.2.raw
  modified_base (375)..(375): a, c, t, g, unknown or other
  modified_base (403)..(403): a, c, t, g, unknown or other
  modified_base (523)..(523): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggtcttattttaaaacgtgtccagtgtgaggtgcagctggcggaggtcgtgggggaggccgtggtacgaggcccggggggtcctgacgactctcctgtgtacgcctcggattcactttagcagactagtggcatgagcgtggtccacaggcctcggaggggacggggccgaggtgggtgtcgagtcagttagtagtagtgagatagattacanacagcctcgagaacggccgacttcactntctatacgagacaacttcccaagaacctactactagtatcttaggactaaatcgtaacgtacggacgtagaacgtcggaacccgacgtaaccgaccggtacctaacgttttaacgttacncgggtacggaaacggaaacggtacgtaaacggggtacccgggtaacgtaaccgtaaacggggtacgtaccgttaccggttcgtttacgtaaacggtcgttaacccg

SEQ ID NO: 374024 - DNA, 617 bp, Homo sapiens
  misc_feature: GZ8MTXP02G0HON.22.82.H05.1.454.CMB.2.raw
  modified_base (297)..(297): a, c, t, g, unknown or other
  modified_base (478)..(478): a, c, t, g, unknown or other
  modified_base (480)..(480): a, c, t, g, unknown or other
tcagacatacgcgtcacgaccggtgctcgatttagtcgagctctctcgcggggtctgagagaggagcccagccctgggattttcaggtgttttcatttggtgatcaggattgaacagagagaactcaccatggagtttgggctgagctggtctttttcttgtggcttaattttaaaacgtgtccagtgtgaggtgcagctggcggagtcgtgggggagcctgggtacagggccgggggggtcctggacgactctcctgtgtagcctccggattcacctttagcagacagtggcatgngcgtcggtccgccgaggcgtccgacggggacggggacgggacggtggggtggtcgagtagtagttagtagtaggtaggtgtagtagtaacttaccgtacaacgacgtacgtaccgtacggaacggccgtccgttcaccgtactctctagacaacacttaccacaacacactagtactctananaatacgtagtagagagacgacgacgacgacgacgtactacgttacgtacgtacgacgacgtaacggtaacgtacggtaccggtacggtaacggtaacggtacggtacgttacgttacggtttacgttacgtacgtcg

SEQ ID NO: 374025 - DNA, 571 bp, Homo sapiens
  misc_feature: GZ8MTXP02HJOWP.22.82.H05.1.454.CMB.2.raw
  modified_base (433)..(433): a, c, t, g, unknown or other
  modified_base (467)..(467): a, c, t, g, unknown or other
  modified_base (470)..(470): a, c, t, g, unknown or other
  modified_base (474)..(474): a, c, t, g, unknown or other
  modified_base (483)..(483): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcagctggcggagtcgtgggggaggcctggtacgagggcccgggggggtccctggagactctcctgtgtacgcctcggattcaccttagcagacatggcatgagctgggtccgccgagctccgaggggaacggggccggagtggggtgtcgagtcattaagtagtaggtggtgaataagaaatttaccacaacagaccgtccgtagaaacggggcctcttcaacccatcctctaagganaacaacttacccaacaaacaacactatatactanaanaaanagagtaganagagacgacgacgacgacgactattatactagacgacgaagagtacgtacggacgacgaacggtacgacgtacgtacgtactacgatg

SEQ ID NO: 374026 - DNA, 753 bp, Homo sapiens
  misc_feature: GZ8MTXP02I8VDN.22.82.H05.1.454.CMB.2.raw
  modified_base (361)..(361): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagttgggctgagctggtctttttcttgtggtcttaattttaaaacgtgtccagtgtgaggtgcagctggcggagtcgtgggggaggccgtggtacgagggtccggggggtccctggacgtactctccgtgtgtacgcctccggtattcacctttagcagactatggcagtggagcgtgggtcccgccgacggtccgtcggagggggaacggggccggaggttcggggngtaccgagtacgtagtttaggtaggtaggttcggagtattaacgtaaatttaacccaacgaaccgaagtaccgtccggttaagggaaaccggggtcccgtcttaccgacctatacctcgtaagaacgtaacctaacttacccgaaagacctaactacttacgtataccgttagaaacgtaaattacggtaacgtacgggacgttaacggacggaaccggacccgaaaccggaaccggtacggtacccctttaaaagtttttaccttaccggttacggaccggaaagggttaaaacggacggtttaaaacggtaccggggttaacccggaaaaggtcccggggtaacgttacccgtaccgggttacgtttacccggtaagtaccgtttcccgg

SEQ ID NO: 374027 - DNA, 720 bp, Homo sapiens
  misc_feature: GZ8MTXP02FHCHI.22.82.H05.1.454.CMB.2.raw
  modified_base (206)..(206): a, c, t, g, unknown or other
  modified_base (433)..(433): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggcttttcttgtggctaattttaaaacgtgtccagtgtgagtgcagctggcgagtcgngggggaggcctggtacacggccgggggggtccctggagactctcctgtgtacgcctccggattcacctttagcagacatggcatgagcgtggggtccgccgaggtctccggaaggggaacggggccggaggtggggtgcgagtctagtttacggagtaggtcggagtagtaagaaactttaccacacaagtcctccggtaggtaacgggtccgtacttcgaaacctnttaccctacgttaagaacgtaacctaaactttccccgaaacgaaacccaacgtaacgttgtaaactccgttagaacctaaacgtacgtaaccgtaagggaccgtaggtaacggaaccggccggaaacccggaccgaacccgggtaccttaaacgttttaacttaaccgttacggccggaaccgggtaaaaggtaacgttacccggttaaaaccgggggtccgaaaaccggtaaaccgggggttcgaaccgtttaccgggaccgttttacgtaacgtacgtttcccgg

SEQ ID NO: 374028 - DNA, 753 bp, Homo sapiens
  misc_feature: GZ8MTXP02GSV53.22.82.H05.1.454.CMB.2.raw
  modified_base (406)..(406): a, c, t, g, unknown or other
  modified_base (636)..(636): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggtcttaattttaaaacgtgtccagtgtgaggtgcagcgtggcggagtcgtgggggaggccgtggtacgagggcccggggggtccctggacgacttctccgtggtcgtacgcccgtccggtattcaccgtttagcagacagtggcatgacgcgtcgggtcccgccgaggcctaccggaaggggaacggggccggaggtgggtgtcgagtctagttagagtaggtggacataagtaacttaccanacagacgtcgtaggaacggggccctcgttaccacctacgttacctacgtaaacggaacgaaaccttaaccgttaccccgaaagtaaaacccaccgtaaacgttacgttaacctcgttaacggaaacctaaaaaggttcgtaaaccgtttagggacctaggaacgggtaaccgacccggaaaccgaaaccgttacccgggaaccctttaaaagtttttaccgttaaaccgngggtaacccggtaaagggaaaacgttacggttaaaccggtaaaccggggtactaaaacccggggtaaaggttcggaacccgttacggttacccgtttagtaacggtaacgttcccgg

SEQ ID NO: 374029 - DNA, 699 bp, Homo sapiens
  misc_feature: GZ8MTXP02FTN8S.22.82.H05.1.454.CMB.2.raw
  modified_base (422)..(422): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaacgtgtccagtgtgaggtgcagcgtggcggagtcggtgggggaggccgtggtacgacgggcccggggggtcctggagacctctccgtgtgtacgccgtccggtattctaccttagcagacagtcggacagtcgagcgtaccgggtccgccgacggccgtaccggagggggacggggccgggtaggttcgggtcgtacgagttacgtagttaaggtaggttaggtggtagtaatagtaactttaccanaaccgagtaccgtcgtaggaacgggcctaccttacacctactctacgtaagaacgaaactaaaccttcccaaacgaacctaactacttacgtaatccgtaagaaactaaatacggaacgttacggacgtaagaacggacgaccggaacgaccgaccgtaacttacgtttacgttacgtcggacgtaacggaaaggtaacgtaacgggtaaccggtacggaaaccgtaacgggtcggttaaccgtacgggttacctttacgaacgtacgttaccccgg

SEQ ID NO: 374030 - DNA, 628 bp, Homo sapiens
  misc_feature: GZ8MTXP02JFJL9.22.82.H05.1.454.CMB.2.raw
  modified_base (304)..(304): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggcctggtacaggccggggggtccctgagactctcctgtgtacgcctcggattcacctttagcagacagtggcatgagctgggtcccncgagcgtccgaggggaacggggccggaggtgggtgtccgagtctagttaaggtacgtaggtggtacgagttaagtaaactttaccaacacgtagaccgtcgtagggaacgggtcccgctttaccacctatcctacgtagaacgaactaacttcccgaaataaccaactactacgtactctaagaacaaatgtaacgttaggctagaacgcgaccgacgtaccaacggtactatttaacttacgagtccgaaaggaaacggtacttaacgggaaccgggtcaaacggaacgggtcgtacgtacgttcggttacgaggtatacccg

SEQ ID NO: 374031 - DNA, 772 bp, Homo sapiens
  misc_feature: GZ8MTXP02JS2TJ.22.82.H05.1.454.CMB.2.raw
  modified_base (302)..(302): a, c, t, g, unknown or other
  modified_base (324)..(324): a, c, t, g, unknown or other
  modified_base (519)..(519): a, c, t, g, unknown or other
tcagacatacgcgtcacgaccggtgctcgatttagtcgagctctctcgcgggtctgagagaggagcccagccctgggattttcaggttgttttcatttggtgatcaggactgaacagagagaactcaccatggagtttgggctgagctggtctttttcttgtggcttattttaaaacgtgtccagtgtgaggtgcagcgtggcggagtcggtgggggagccgtgggtacgacgggcccggggggtcctggacgtaccgtcttccgtgtgtacgcctccggattccaccgtttagacacgacngtggcatgagcgtggcccgcgnggcgtcggaaggggagggccggaggtgggtgtacgagtctaagttaggtagtaggtggtactagtaacgtaaacttaccacacgacgtaccgtccggtagggaacggtcccgtacttaaccgacctactccttacgtaaagaacgtacctaaaccttccccgaaaagaacctaacgtaactacgtacttccgaanaacctaaaagttcgaaacgttagggacctaggaaacgtacccgggaacccgtaacggtaacgtaacccggtacttttaaaagttaccggttaacgacggggaaacccggttaaagggtaaaaacgggtaccgttttaaaccggggaaaaccgggggtacctaaaaaccggggaaccgggggtttccgtaaaacccgtttaccccgggggttaaccccgtttaacgtaaccgggggttaacgtttacccccggg

SEQ ID NO: 374032 - DNA, 744 bp, Homo sapiens
  misc_feature: GZ8MTXP02IY1WI.22.82.H05.1.454.CMB.2.raw
  modified_base (266)..(266): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctaattttaaaacgtgtccagtgtgaggtgcagcgtggcggagtcgtgggggaggcctggtacgaggccgggggtcctgagactctcctgtgtagcctcggnttcacttagcagacagtggcagtgagcgtcggtccccgcgacggccgtaccggagggggaacggggccggaggtcgggtcgtcgagtctaagtttagtaggtagttggtagtaagtaacgtaacgttaaccaacgtaaccaacggtaccgttccggtacggggaaaccgggtccccgtaccttaccaacctacgttccaacgttaaggaaactaaacctaaaccttcccgaaaacgaaaccctaactaaccgtttagttaactccgttaacgtaaaccgtaaaagtcggtaaacgttacgggcgttaaacgaaccggaacggaccccggaacgaaaccgtaccggtaccttaagttttaactaccgtggaacccggaagtaaaacgggtaacttacgggtaacccgggggtaccaaaacggggtaaccggggtcgtaaccggttaccggttcggtttaaacctaggtaacgtttcccg

SEQ ID NO: 374033 - DNA, 738 bp, Homo sapiens
  misc_feature: GZ8MTXP02ISKZ1.22.82.H05.1.454.CMB.2.raw
  modified_base (242)..(242): a, c, t, g, unknown or other
  modified_base (276)..(276): a, c, t, g, unknown or other
  modified_base (284)..(284): a, c, t, g, unknown or other
  modified_base (341)..(341): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtcttttcttgtggcttatttaaaacgtgtccagtgtgaggtgcagcgtggcggagtcgtgggggagcctggtacgacggccggggggtcccngagactctcctgtgtagcctcggatcacttgcancagtgcangagcgtagggtcccgccgtaggcctacggaggggaacggggccggtaggtcggggtntcgtagtacgtaagttaggtacgtaaggtggtagtagttaacgaacttttaaccgactaaccgaacggcccgttccggtaggaaaccgggtcccccgtctttacccggaaacctacgtaccgtacgttaagaacggtaactaaacctttacccgaaacgaaacctactaacgttacgtaaactccgttaaggaaccctaaaatacggtaaccgttaaagggtcgtaacggaaacgaccggtacccggtaacggaaaccgtacgggttacccttaattttaaacgtttaaccggcgtaacggaccggtaaaagggtattaacggttaaaccgggggtcaaaaccgtaacgggttcggaacgttaacggttccgtttacggttaacggctttaacccgg

SEQ ID NO: 374034 - DNA, 645 bp, Homo sapiens
  misc_feature: GZ8MTXP02I6WKF.22.82.H05.1.454.CMB.2.raw
  modified_base (298)..(298): a, c, t, g, unknown or other
  modified_base (330)..(330): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggctattttaaaacgtgtccagtgtgaggtgcagctggcggagtcgtgggggaggcctggtacaggccgggggggtcctgagactctcctgtgtagcctcggattcactttagcagacatggcatgagctggtccncaggctccgaggggaaggggccggagtgggtntcgagtcattagtagtaggtggtgatagtaaactttaccacacagactcggtaggaacgggtccgcttacaacctatcctactaagaacgacctaaacttacccaaagaaaccaaccacgtagtaactcttacgaacctaaaagtacgaacttaagggacctagaaacgtacgacccggaaacggacctaaccgggacccttaaaatttaattacccgtacggacggaaacggaaaggtacttaacggtaaccggggtacgaaaccgtaaagggggccgtacgtaaaccgggtcttttacgaaaggtacttccgg

SEQ ID NO: 374035 - DNA, 628 bp, Homo sapiens
  misc_feature: GZ8MTXP02IQVI2.22.82.H05.1.454.CMB.2.raw
  modified_base (378)..(378): a, c, t, g, unknown or other
  modified_base (407)..(407): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggctttttcttgtggctattttaaaacgtgtccagtgtgaggtgcagctggcggagtcgtgggggaggcctggtacaggccgggggggtccctgagactctcctgtgtagcctcggattcacctttagcagacatggcatgagctgggtcccgccgaggcgtcccgaggggaacgggggccggaggtggggtgtcagtcagttagtagtagtggtgatagaatttaccanacagactcgtgaacgggcctcttcacctntctcagagacacttcccagaaccacactgtatctgactaaatcgataggctaggacgtacgaccggacgaacgaccgggtacctaaagttttactttaactcggacggtaccgtaaaagggacttaacggttaacccgggggtaactaaacccggtaaaacggggttcggggacccgtttaaaccgggttccggtttttacccgtagggtaactttcccgg

SEQ ID NO: 374036 - DNA, 677 bp, Homo sapiens
  misc_feature: GZ8MTXP02H98G0.22.82.H05.1.454.CMB.2.raw
  modified_base (178)..(178): a, c, t, g, unknown or other
  modified_base (246)..(246): a, c, t, g, unknown or other
  modified_base (282)..(282): a, c, t, g, unknown or other
  modified_base (299)..(299): a, c, t, g, unknown or other
tcagacatacgcgtcacgaccggtgctcgatttagtcgagctctctcgcggggtctgagagaggagcccagccctgggatttttcaggtgttttcatttggtgatcaggactgaacagagagaactcaccatggagtttgggctgagctggtcttttctgtggcttaatttaaacgtntccagtgtgaggtgcagcgtgggcggagtcggtgggggacggcctggtacgacgggccggggggtccnggagctctctgtgtcgcctcggtattctacctttanacagacagtggcatagngcgtcgggtccccgcgacgccgtaccggaggggaacggggccggtaggtggggtgtacgtagtactagtttaaggtggtaggtaggtagtagtaagttaactttaaccactacgacgtccgttacgtacggaacggcccgtcgttacacctacgtctagaacgataacctaactaccccgaaagacccaaacgtactacgtactcgagttaaaccgaaagtacgaaccgtaggtaccgagacggacggaacccgaacgaccgtaaccggtaactttacgttaaacgtttccgagtaccggacggtaaagtaacgttaacggtacggttacgaaccgtaacggtcggtaacgttacggttacgtttccaacgtactcgg

SEQ ID NO: 374037 - DNA, 709 bp, Homo sapiens
  misc_feature: GZ8MTXP02JGH61.22.82.H05.1.454.CMB.2.raw
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttaattttaaaacgtgtccagtgtgaggtgcgagctggcggagtcggtgggggacggccgtggtacgacgggtcccggggggtccctggacgaccttcgtccgtgtgtacgcccgtcggtattctaccttagcctagacgagtcggatagtgagccgtcgggtacccgcgacggccgtaccgggaacgggggaacggggccgggtaggtcggggtgtacgtagttctaagtttagtaggtaggtggtagtaagtaacgtaacttaccgaactacgacgtccgtacgaacggaacggggtccctacttcccgaaactacttaccgtacgtaaacgtaaccgtaaacctaaacccgttaccccgaaaagtaaccctaactacgttacgtaactccgtaagaaaccgtaaagtcgtaccgtaaggtctaaggacggacaccggaacgacgtaccgacttaagttaactcggtagacgaacggaaatacgtacgtaacggaccgaacggtaacgggtctaaccggtacgttacgttcgaaggtctccg

SEQ ID NO: 374038 - DNA, 610 bp, Homo sapiens
  misc_feature: GZ8MTXP02JCGC4.22.82.H05.1.454.CMB.2.raw
  modified_base (309)..(309): a, c, t, g, unknown or other
  modified_base (384)..(384): a, c, t, g, unknown or other
  modified_base (422)..(422): a, c, t, g, unknown or other
  modified_base (436)..(436): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggagccgtggtacgagggcccggggggtccctggacgactctcctgtgtagcctcggattctacctttagcagacatggcatgagcgtgggtcccncgaggcctcgaggggaacggggccggaggtgggtgtcgagtctagttagtagtaggtgtagatagaatttaccanacagcgtcgtaggaacgggcctcttcacctatctgtanagacacttcccganaaccacacgttgactcgtaagactaaagtcgtaacgtacggctaagacgacgacccgacgtaacgccggtaccttaagttactttacgagtaccgaacggtaaaggtaactacggtaacggtccgaaacgtaacgggtcggtacttacgggtacgtttcgtaaacggtcgtacg

SEQ ID NO: 374039 - DNA, 613 bp, Homo sapiens
  misc_feature: GZ8MTXP02HWU9W.22.82.H05.1.454.CMB.2.raw
  modified_base (413)..(413): a, c, t, g, unknown or other
  modified_base (501)..(501): a, c, t, g, unknown or other
  modified_base (504)..(504): a, c, t, g, unknown or other
  modified_base (515)..(515): a, c, t, g, unknown or other
tcagacatacgcgtcacgaccggtgctcgatttagtcgagctctctcgcggggtctgagagaggagcccagccctgggattttcaggtgttttcatttggtgatcaggactgaacagagagaactcaccatggagtttggactgagctggtcttttttcttgtggtacttattttaaaacgtgtccagtgtgaggtgcagctggcggagtcgtgggggagcctggtacgaggccgggggggtcctgagacgtctctggtgtacgtccgtccggtattcacctttagcagacagtgcatgagcgtggccgacaggctccggacggggaaggggccggaggtcgggttgtacgtgtccgtatagtagtagtggtcacgttagtaactttaccgactaacaaggtccgttaccggnggtaaacggggccccctaagttcaaccctagtccagtagacacaacttaccacgaacataacgtgtactcatacgaaatcgataggcnganacgtcccgaanactaccggactatttacccgtagcgacgacgaagtaactacggtaaccgggcaaacgtaacgggtcgacgtacgttcgtttaacgtcgtaagttcccg

SEQ ID NO: 374040 - DNA, 687 bp, Homo sapiens
  misc_feature: GZ8MTXP02IBLTV.22.82.H05.1.454.CMB.2.raw
  modified_base (159)..(159): a, c, t, g, unknown or other
  modified_base (245)..(245): a, c, t, g, unknown or other
  modified_base (286)..(286): a, c, t, g, unknown or other
  modified_base (368)..(368): a, c, t, g, unknown or other
  modified_base (550)..(550): a, c, t, g, unknown or other
  modified_base (563)..(563): a, c, t, g, unknown or other
tcagacatacgcgtcacgaccggtgctcgatttagtcgagctctctcgcggggtctgagagaggagccccagccctgggattttcaggtgttttcatttggtgatcaggactgaacagagagaactcaccatggagtttgggctgagctggtctttttnttgtggcttaattttaaaacgtgtccagtgtgaggtgcagctgggcggagtcgtgggggagccgtggtacgaggcccggggggtcngagactctcctgtgtagcccgtcggacttcacctttagcanacctagcggacatagcgcggtcgggtcccgcgaggcccgtcggacgggggacggggccggaggttcgggtagtcgacggttntagttaaggtaggttaggaggttgtaagtaacgtttaacgttaccaacaaacgacgtacccgtcgggttacggaaacggggcccttacgtcccaaactacgtacccgtagtaagacgtaaaccttaaaccggttacccaaaacgaacctaacgtaccttagtacgtactacggaattaaacngtacgtacggganagagaccgacgtacgacgtacgtacttacgttagtaccgacgacgggtaacgtaaacgtacgtacgggtaaccggtacggaacggtaacggttcgtaccgttcggttacgtacgtagtcctacg

SEQ ID NO: 374041 - DNA, 769 bp, Homo sapiens
  misc_feature: GZ8MTXP02FH9JG.22.82.H05.1.454.CMB.2.raw
  modified_base (215)..(215): a, c, t, g, unknown or other
  modified_base (457)..(457): a, c, t, g, unknown or other
tcagacatacgcgtcacgaccggtgctcgatttagtcgagctctctcgcggggtctgagagaggagcccagccctgggattttcaggttgttttcatttggtgatcaggactgaacagagagaactcaccatggagtttgggctgagctggtctttttcttgtggtacttaattttaaaacgtgtccagtgtgaggtgcagcgtggcggagtcgngggggagccgtggtacgacgggccgggggtcctgagactctccgtgtgtacgcctccggtattctacctttagctagacagtggcagtgagcgtcgggtccgccgaggcctaccggaaggggacggggaccggaggtcggggtcgtagacgtacgtagtttagtaggttaggtaggtagtaagttaaagtaaactttaacccgacgtaacaacggtccgtaccgggtaggaacggggtcccnccttacgacctactaccgtacgtaaaggactaactaaaccgttcccgaaagaacctaaccgtaacgttagttacctcgtaacgtaaacgtaaactacggtaaacgtacggtaacgggttacgaaacggaccggaaccccgaaacggacccgtaaacccgggtacctttaaacgtttaaccgttaccggttacgaacccgggaaggtaaaacgggttaacgtaaacgggttaaccgggggaaccgtaaacgggtaaccggggtaccggttaccggttaacccggttacgtttaaccgtaaggtacggttcccg

SEQ ID NO: 374042 - DNA, 673 bp, Homo sapiens
  misc_feature: GZ8MTXP02FJK94.22.82.H05.1.454.CMB.2.raw
  modified_base (290)..(290): a, c, t, g, unknown or other
tcagacatacgcgtcacgaccggtgctcgatttagtcgagctctctcgcgggggtctgagagaggagcccagccctgggattttcaggtgttttcatttggtgatcaggactgaacagagagaactcaccatggagtttgggctgagctggtctttttcttgtggcttattttaaaacgtgtccagtgtgaggtgcagctggcggagtcgtgggggaggcctggtacgacggccggggggtccctggacgactctcctgtgtacgccgtccggattcacttagcagacanggcatgagcgtggtccgcaggctccggaggggaacggggccggaggtgggtgtcgtagtctattaggagtacgtggtacgtagtaacgaatttaaccactaccaagtcctccgggtaggaaacggggcccgtacttccaacccgtactccttacgtaagacgaactaaacttaccccgaaagaacccaactaaccttgtaaattccgtagaacctaaacgtacgtaacgtagggttactagacgaacggacccgaacgaccgaccggtaccttaagtttactacgtcggacggaacggtaaaggacttaacggtaaccggggtaccgaaaacggtaacggtacggtaccgtaaccggtcgtttaccgtaaggtacgttacccg

SEQ ID NO: 374043 - DNA, 541 bp, Homo sapiens
  misc_feature: GZ8MTXP01D4PGD.17.31.C09.1.454.CMB.2.raw
  modified_base (297)..(297): a, c, t, g, unknown or other
  modified_base (451)..(451): a, c, t, g, unknown or other
  modified_base (506)..(506): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaacactcctgacccctgccgttctcaggctcctcgtgggggcaaagctgccctgcccgttcgggtgccgtcagcctgaggatgaggctgagttattactgcttgctctcctattagtggggtgttcggggtgttcggcggnggacctaagctgtacccgtctacggtcaagcccagggcttcgccccctggttccncttctcgtccccaaccctcctccttatcgttcgcg

SEQ ID NO: 374044 - DNA, 530 bp, Homo sapiens
  misc_feature: GZ8MTXP01EWOW9.17.31.C09.1.454.CMB.2.raw
  modified_base (496)..(496): a, c, t, g, unknown or other
  modified_base (523)..(523): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattatcgatacaaacacaaacaactcctggacccctgcccggtctcaggctccctcgttgggggcaaaggctcgccctcgaccctttcgggtcgcgccagcctgaggggactgaggctgagtattactgcttgctctcctaatgttggtgttcgggtgttcgggcggnggaccgaagctggccgtcgttaggtcngaacccg

SEQ ID NO: 374045 - DNA, 563 bp, Homo sapiens
  misc_feature: GZ8MTXP01B3TZM.17.31.C09.1.454.CMB.2.raw
  modified_base (297)..(297): a, c, t, g, unknown or other
  modified_base (338)..(338): a, c, t, g, unknown or other
  modified_base (457)..(457): a, c, t, g, unknown or other
  modified_base (523)..(523): a, c, t, g, unknown or other
  modified_base (537)..(537): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaacactcctggaccccctgcccggttcncaggctccctcgttcgggggcaaagctgccctgccctttcgggtgcgcagcctggacggatgaggctgagtattactgcttgcttctcctagtagtggggtgttcggggtgtttcgggnggtagggccaaggctcgtaccgtccgtaggtcaaggccccaagggccttcgccccctcgggttccncttctcgttccccncccttcctccttacgtccttaacgcg

SEQ ID NO: 374046 - DNA, 531 bp, Homo sapiens
  misc_feature: GZ8MTXP01AI3VN.17.31.C09.1.454.CMB.2.raw
  modified_base (381)..(381): a, c, t, g, unknown or other
  modified_base (390)..(390): a, c, t, g, unknown or other
  modified_base (448)..(448): a, c, t, g, unknown or other
  modified_base (484)..(484): a, c, t, g, unknown or other
  modified_base (496)..(496): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggcccaagccccccaggacactgatttatgatacaaacaacaaacactcctggacccctgcccggttctcaggctcctcgttgggggcaaagctgccctgtcccttcgggngcgcagccngaggatgaggctgagtattactgcttgctctcctatagtgggtgttgggtgttcgggnggaggccagcgtgaccgtctagtcaagcccaggccngccccgtggccncgttctcgtcccgccctcctccttgtccttcgtcg

SEQ ID NO: 374047 - DNA, 537 bp, Homo sapiens
  misc_feature: GZ8MTXP01CJGHZ.17.31.C09.1.454.CMB.2.raw
  modified_base (271)..(271): a, c, t, g, unknown or other
  modified_base (298)..(298): a, c, t, g, unknown or other
  modified_base (502)..(502): a, c, t, g, unknown or other
  modified_base (515)..(515): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcccctactggttccaacagaagccnggccaagcccccaggacactgatttangatacaaacaacaaacactcctggacccctgcccggttctcaggctcctccgttgggggcaaagctgccctgccctttcgggtgcgcagcctgaggatgaggctgagtattactgcttgcttctctatagtggggtgttcgggtgttcgggcggtaggccagctgaccgtctaggtcaagcccaggcttcgccccctggttccncttctcgttcccnccctcctccttagtccttcgcg

SEQ ID NO: 374048 - DNA, 531 bp, Homo sapiens
  misc_feature: GZ8MTXP01CKPJ1.17.31.C09.1.454.CMB.2.raw
  modified_base (503)..(503): a, c, t, g, unknown or other
  modified_base (515)..(515): a, c, t, g, unknown or other
  modified_base (527)..(527): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggacactgatttatgatacaaacaacaaacactcctggacccctgcccggttctcaggctcctccggttggggcaagctcgccctgtccctttcgggtcgcgcagcctgaggatgaggctgagtattactgcttgcttctctatagtggggtgttcggggtgttcgggcggagggccaaggctgaccgtctaggtcaagccaggcttcgcccctgttcncttctcgtcccncctctcagtccngtcg

SEQ ID NO: 374049 - DNA, 540 bp, Homo sapiens
  misc_feature: GZ8MTXP01E4NGK.17.31.C09.1.454.CMB.2.raw
  modified_base (502)..(502): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctcctccgttgggggcaaagctgccctgccctttcgggtgcgcagcctgagatgaggctgagtattactgcttgctctctatagtggggtgttcggggtgttcggcggaggccaagctgccgtctaggtcaagcccgaaggccttcgccccctcggttccncttctcgtccccgccctccctccttacgtcttaacgcg

SEQ ID NO: 374050 - DNA, 524 bp, Homo sapiens
  misc_feature: GZ8MTXP01BUF98.17.31.C09.1.454.CMB.2.raw
  modified_base (331)..(331): a, c, t, g, unknown or other
  modified_base (394)..(394): a, c, t, g, unknown or other
  modified_base (487)..(487): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggaggacagtcactctcactgtggctcagcactggagctgtcaccaatggtcattatccctactggttccaacagaagcctggccaagcccccaggacactgatttangatacaaacaacaaacaactcctggacccctgcccggtctcaggctccctgttggggcaagcngccctcgaccctttcgggtgcgcagcctgaggggactggaggctgagtattacgtgcttgctctctaatgttggtgttcgggtgttcggcggngggaccaagctgaccgtcgttaggtccaagtaacccg

SEQ ID NO: 374051 - DNA, 542 bp, Homo sapiens
  misc_feature: GZ8MTXP01EDMM1.17.31.C09.1.454.CMB.2.raw
  modified_base (270)..(270): a, c, t, g, unknown or other
  modified_base (476)..(476): a, c, t, g, unknown or other
  modified_base (503)..(503): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagccnggccaacgcccccaggacactgattatgataacaaacaacaaacactcctacgaccctgccgtctcagctcctccgtggggcaagctcgccctgtcccgtttcgggtcgccgcgacgcctggacggatgaggctgagtattactgcttgctctctatgtggggtgttcgggtgtcgggcggtaggccagctcgtccgtcgtggtcncgcccgaggccttcgcccctggttccncttcctcgtccccgtcctccgtccttagtccttcgtccg

SEQ ID NO: 374052 - DNA, 536 bp, Homo sapiens
  misc_feature: GZ8MTXP01D5LHL.17.31.C09.1.454.CMB.2.raw
  modified_base (271)..(271): a, c, t, g, unknown or other
  modified_base (299)..(299): a, c, t, g, unknown or other
  modified_base (379)..(379): a, c, t, g, unknown or other
  modified_base (449)..(449): a, c, t, g, unknown or other
  modified_base (498)..(498): a, c, t, g, unknown or other
  modified_base (512)..(512): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcccctactggttccaacagaagccnggccaagccccccaggacactgatttangatacaaacaacaaacactcctggacccctgcccgttctcaggctcctcgttgggggcaagctgccctgccctttgggcncgcagcctgagatgaggctgagtattactgcttgctctctatagtggggtgtttcgggtgttcgggcggnggaccagctgaccgtctggtcaagcccaggccttcgccccgtggttccncttcctcgtccccncccttcctccttacgtcttcgtcg

SEQ ID NO: 374053 - DNA, 620 bp, Homo sapiens
  misc_feature: GZ8MTXP01DAZC4.17.31.C09.1.454.CMB.2.raw
  modified_base (270)..(270): a, c, t, g, unknown or other
  modified_base (297)..(297): a, c, t, g, unknown or other
  modified_base (343)..(343): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggtccaacagaagccnggccaacgcccccaggacactgattangaataacaaacaaacaaacactcctacggacccctcgcccggttcncgacggctcccgtcggttcggggacaaagctcgccctcgtcccgttgggctcgcagcctgacgatgaggctgagttatactgcttcgctctactagtaggttggggtcggtttcggggtgttcgggcggacgggaccgaagtccgtacgtaccgtccgttacggcgaaccggtcccgaacgggtcccttccggtcccccgttcggttaccccttaccgttccgttcccgttccccctaacccctttcctcccgttaacgtcccgttaaccgtcccgg

SEQ ID NO: 374054 - DNA, 524 bp, Homo sapiens
  misc_feature: GZ8MTXP01DT1FC.17.31.C09.1.454.CMB.2.raw
  modified_base (270)..(270): a, c, t, g, unknown or other
  modified_base (297)..(297): a, c, t, g, unknown or other
  modified_base (440)..(440): a, c, t, g, unknown or other
  modified_base (489)..(489): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagccnggccaagcccccaggacactgatttangatacaaacaacaaacactcctggacccctgcccgttctcaggctcctcgtggggcaaagctgccctgcccgttcgggtgcgcagcctgagatgaggctgagtatactgctgctctctatagtggggtgttcgggtgttcggnggaggcaagctgtaccgtctaggtcaagcccaaggcttcgcccctggcncttctcgtcccaaccctctccttagtcttaacgcg

SEQ ID NO: 374055 - DNA, 534 bp, Homo sapiens
  misc_feature: GZ8MTXP01DKXRK.17.31.C09.1.454.CMB.2.raw
  modified_base (358)..(358): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcccctactggttccaacagaagcctggccaagcccccaggacactgatttatgatacaaacaacaaacaactccnggacccctgcccggttctcaggctccctcgttggggcaaagctacgccctgaccctttcgggtgcgcagcctgaggggatggagctgagtattactgcttgctctcctaatcgttggtgttcgggtgttcggcgggttaggaccgaagctggaccgtccgttaggtcgcgaacccg

SEQ ID NO: 374056 - DNA, 638 bp, Homo sapiens
  misc_feature: GZ8MTXP01CWXS3.17.31.C09.1.454.CMB.2.raw
  modified_base (263)..(263): a, c, t, g, unknown or other
  modified_base (266)..(266): a, c, t, g, unknown or other
  modified_base (291)..(291): a, c, t, g, unknown or other
  modified_base (329)..(329): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactcctatgtccaacaganccngccaacgccccagacactgtattangataacaaacaacaaacactcctcgaccctgcccgttntcaggcctccgtccggtgggggacaagctcgccctcgtcccgttcgggcgcgcagccgtagacggatcgaggctgagttatacgtgtcttgccttctccgtagttacggttgggggttcggtttacggggtcgttcggggacgggtacgggaaccgtaaggtccgtacggtacccggttaccgtacgggttccgaaccggtaccccgaacgggtcccttccggtccccccgtcgggttacccttacccttcccgtttcccgttccccctaaccccgtttccctacccttacggttcccgaacgtcccgg

SEQ ID NO: 374057 - DNA, 537 bp, Homo sapiens
  misc_feature: GZ8MTXP01BZSV3.17.31.C09.1.454.CMB.2.raw
  modified_base (503)..(503): a, c, t, g, unknown or other
  modified_base (507)..(507): a, c, t, g, unknown or other
  modified_base (516)..(516): a, c, t, g, unknown or other
  modified_base (532)..(532): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatcgatacaaacaacaaacaactcctggacccctgcccggttctcacggctcccctcgttcgggggctaaagctcgcccgtcgaccccgtttcggggcgtcggcagccctgaggggatgaggctgagtattactgtcttgctctcctaagtgttggtgttcgggtgtcggngggngggcaagcncgacgtcgttagtcgngcccg

SEQ ID NO: 374058 - DNA, 619 bp, Homo sapiens
  misc_feature: GZ8MTXP01D7L8H.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggaccaacgcccccaggacactgatttatcgactaacaaacaacaaacaacctccctcggacccctcgaccccggtttctccgacgggtccttcccgtcggttcgggggtaccaaacggtcctcgtccccgttacggtaccccgtttcggggtcgcgcgacgcctggaggggactggaggtcgtgtagttattacgtgtcttgtccttctcctaattgggttggttcggtttcgggttcgggtttcgggcgggttacgggaccgaacggtcgtaacggtacccgttcgttacggtccgaacggtaaccccgg

SEQ ID NO: 374059 - DNA, 533 bp, Homo sapiens
  misc_feature: GZ8MTXP01C50W1.17.31.C09.1.454.CMB.2.raw
  modified_base (270)..(270): a, c, t, g, unknown or other
  modified_base (297)..(297): a, c, t, g, unknown or other
  modified_base (336)..(336): a, c, t, g, unknown or other
  modified_base (450)..(450): a, c, t, g, unknown or other
  modified_base (485)..(485): a, c, t, g, unknown or other
  modified_base (498)..(498): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagccnggccaagcccccaggacactgatttangatacaaacaacaaacactcctggacccctgcccggttntcaggctccctcgttgggggcaagctgccctgcccgtttcgggtcgcgcagcctgacgatgaggctgagtatactgtcttgctctcctatagtggggtgttcggggtgttcggnggaggaccagctgaccgtctaggtcaagccaggcncgcccctggttcncttctcgtcccgcctcctccttagtcttaacgtcg

SEQ ID NO: 374060 - DNA, 534 bp, Homo sapiens
  misc_feature: GZ8MTXP01BGTM2.17.31.C09.1.454.CMB.2.raw
  modified_base (389)..(389): a, c, t, g, unknown or other
  modified_base (499)..(499): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcccctatggttccaacagaagcctggccaagccccccaggacactgatttatgatacaaacaacaaacactcctgacccctgccggtctcagctcctcgttggggcaagctgccctgccctttcgggtcgcgcagcctgaggntgaggctgagtattactgcttgctctctatagtggggtgttcgggtgttcggtcggaggaccaagctcgaccgtcctaggtcaagcccgaggccttcgcccctcggttcncttctctcccgccctcctccttacgtccttcgtcg

SEQ ID NO: 374061 - DNA, 598 bp, Homo sapiens
  misc_feature: GZ8MTXP01CUOQI.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcacaatggtcattatccctactggttccaacagaagcctggtcaagcccccaggacactgatttatcgataacaaacaacaaacaacctacctcggacccctgccccggttctcaggcctccctcgttcgggggcaaacgctcgccctgtaccccgtttcgggtcgcgcacgccgtggaggggagtggaaggccgtaggtagttagttacgttggtcttcggcttcttccttaagttacggttgggttgggttcggggttggtttcgggacgggttcggggaccgtaaaggccgtcgacccggttccgttagggtccgcggtaaccccgg

SEQ ID NO: 374062 - DNA, 668 bp, Homo sapiens
  misc_feature: GZ8MTXP01CHGC8.17.31.C09.1.454.CMB.2.raw
  modified_base (297)..(297): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaacgcccccaggacactgatttangatacaaacaacaaacactcctcggacccctgcccggttctcacggtctccgtccggttcgggggcaaaggcctcgcccctcggtccccgtttcggggtcgccgtcaggcccgtaggacggtagtggaggtcgtaggtaagttacttacgtcgtcttgtccttcttacgttagttaggttcggggggttggtttcggggttcgggttaccggggcggggtaacgggaccgaaggtccgtacggtacccggtacgtacggtccaacggtcccgaacggtcccgttcccgtcccccgttcgggttacccgttccttcccgttcccgttccccctccccgtttccctaccgttaccgttccgttaacggtccgg

SEQ ID NO: 374063 - DNA, 546 bp, Homo sapiens
  misc_feature: GZ8MTXP01BNMVZ.17.31.C09.1.454.CMB.2.raw
  modified_base (270)..(270): a, c, t, g, unknown or other
  modified_base (520)..(520): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagccnggccaagccccccaggacactgattatgatacaaacaacaaacactcctgacccctgccgtctcagctcctcgttggggcaagctgccctgcccttgggtcgcgcagcctgagatcgaggctgagtattactgtcttgctctcctatacgtggggtgttcggggtgttcgggcggagggaccaaggcctgtaccgtctaggtcaagtcccgaaggccttcggccccctggttccgcttcgtcgttccccncccgtcctccttacgtccttaacgcg

SEQ ID NO: 374064 - DNA, 537 bp, Homo sapiens
  misc_feature: GZ8MTXP01EZXC2.17.31.C09.1.454.CMB.2.raw
  modified_base (270)..(270): a, c, t, g, unknown or other
  modified_base (297)..(297): a, c, t, g, unknown or other
  modified_base (503)..(503): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagccnggccaagccccccaggacactgattangatacaaacaacaaacactcctgacccctgcccggttctcaggctcctcgttggggacaagctgccctgccctttcgggtgcgcagcctgacgatgaggctgagtattactgtcttgcttctcctataggtggggttgttcggggtgttcgggcggtagggccaagctgaccgtctaggtcaagcccaggcttcgcccctggttcncttctcgtccccgcctcctcttagtccttcgtcg

SEQ ID NO: 374065 - DNA, 536 bp, Homo sapiens
  misc_feature: GZ8MTXP01ECSHG.17.31.C09.1.454.CMB.2.raw
  modified_base (262)..(262): a, c, t, g, unknown or other
  modified_base (269)..(269): a, c, t, g, unknown or other
  modified_base (296)..(296): a, c, t, g, unknown or other
  modified_base (332)..(332): a, c, t, g, unknown or other
  modified_base (497)..(497): a, c, t, g, unknown or other
  modified_base (512)..(512): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtcccccaggagggacagtcactctcacctgtggctccagcactggagctgtcaccaatggtcattatccctatggttcaacngaagccnggccaagcccccaggacactgatttangatacaaacaacaaacactctgacccctgccgttcncagctcctcgtggggcaagctgccctgccctttcgggtcgcgcagcctgacggatgaggctgagttattactgtctgctctctatgtggggtgttggggtgttcgggcggagggacaagcgtgaccgtcgtacgtcaagcccaaggccttcgccccctggttccncttcctcgttccccnccctccctcttacgtccaacgtcg

SEQ ID NO: 374066 - DNA, 550 bp, Homo sapiens
  misc_feature: GZ8MTXP01COHOF.17.31.C09.1.454.CMB.2.raw
  modified_base (334)..(334): a, c, t, g, unknown or other
  modified_base (359)..(359): a, c, t, g, unknown or other
  modified_base (378)..(378): a, c, t, g, unknown or other
  modified_base (449)..(449): a, c, t, g, unknown or other
  modified_base (462)..(462): a, c, t, g, unknown or other
  modified_base (510)..(510): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggaggacagtcactctcactgtgctcagcactggagctgtcaccaatggtcattactccctactggttaccaacagaagcctcggccaacgcccccaggacactgatttancgatacaaacaacaaacaactcccncggacccctgcccggttcncgacggctcccgtcggttcgggggcaaacgctcgccctgtacccgtttcgggcgcgctagcctggaggggntggagctggagtnttactgcttgctctcctgtagttgggttgttcggggtgtcgggcgggngggaccgtaagcgtgaccgtccgttaggtcgcgtaacccg

SEQ ID NO: 374067 - DNA, 545 bp, Homo sapiens
  misc_feature: GZ8MTXP01BJO2K.17.31.C09.1.454.CMB.2.raw
  modified_base (467)..(467): a, c, t, g, unknown or other
  modified_base (493)..(493): a, c, t, g, unknown or other
  modified_base (501)..(501): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgataacaaacaaacaaacactcctacggacccctggcccggttctcacggctcccgtccggttgggggacaaagcctagcccctgcccgtttcgggcgtcgcagcctgacggatggagctgagtattactgcttgcttctctagttagtggggtgttcgggtgttcgggnggaggaccaagctgaccgtctggtcncgcaggcncgcccctcggcttcttctctcccaaccttcctcacgtcttcgcg

SEQ ID NO: 374068 - DNA, 525 bp, Homo sapiens
  misc_feature: GZ8MTXP01AJNK8.17.31.C09.1.454.CMB.2.raw
  modified_base (335)..(335): a, c, t, g, unknown or other
  modified_base (469)..(469): a, c, t, g, unknown or other
  modified_base (491)..(491): a, c, t, g, unknown or other
  modified_base (494)..(494): a, c, t, g, unknown or other
  modified_base (501)..(501): a, c, t, g, unknown or other
  modified_base (520)..(520): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcccctactggttccaacagaagcctggccaagcccccaggacactgatttangatacaaacaacaaacactcctggacccctgcccgttctcaggctccctcgttggggcaaagctcgccctgacccgtttcgggtcgccgcagcctggacggggagtgaggctgagtattactgcttgctctctntgttggtgttcgggtgtcgggnggnggcaagntcgaccgtcgttaggtcgngcccg

SEQ ID NO: 374069 - DNA, 562 bp, Homo sapiens
  misc_feature: GZ8MTXP01DOXW2.17.31.C09.1.454.CMB.2.raw
  modified_base (226)..(226): a, c, t, g, unknown or other
  modified_base (263)..(263): a, c, t, g, unknown or other
  modified_base (265)..(265): a, c, t, g, unknown or other
  modified_base (291)..(291): a, c, t, g, unknown or other
  modified_base (454)..(454): a, c, t, g, unknown or other
  modified_base (522)..(522): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatgtcattatccctatgtccaacagaancnggccaacgcccccagacactgattangataacaaacaacaaacactcctcggacccctcgcccggttctcacgctcccgtcggttcgggggacaaagctcgccctcgtcccgttcgggtcgcgcagccgtgagatgaggctagagtattactgtctgctctctatagtggggtgttcgggtgttcgggnggaggacaagctcggacccgtcgtacggtcgaacgcccgaagggccttccggcccccgttgggttccncttccgtccgttcccgccttccctcttacgtcttaacgcg

SEQ ID NO: 374070 - DNA, 616 bp, Homo sapiens
  misc_feature: GZ8MTXP01EU287.17.31.C09.1.454.CMB.2.raw
  modified_base (489)..(489): a, c, t, g, unknown or other
  modified_base (501)..(501): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtggctcagcactggagctgtcaccaatggtcattactccctactcggttaccaaacagaacgcctcggacccaaccgcccccgaaggaccactgtatttatacgaactaacaaaacaaaccgaaacccaaccttacccgtcggaaccccctcggtcccccgggtttctaccgacgggtcccttccccgtcgggttcgggggaccaaacggccgtcgcccgtcgtacccgtttcgggtcgcgcngccgtggagggngtggagcgtgagttagttacgtcgtcttgtcctcttctaagtcgttgggtggttcgggtggttcgggcgggttaggaccgaagtcgtcggtccgtcgttacggtcgcggaacccg

SEQ ID NO: 374071 - DNA, 538 bp, Homo sapiens
  misc_feature: GZ8MTXP01A8XI4.17.31.C09.1.454.CMB.2.raw
  modified_base (266)..(266): a, c, t, g, unknown or other
  modified_base (292)..(292): a, c, t, g, unknown or other
  modified_base (505)..(505): a, c, t, g, unknown or other
  modified_base (523)..(523): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatgtccaacagaagcnggccaagcccccaggacactgattangatacaaacaacaaacactcctggacccctgcccggttctcaggcctcccgtccggttgggggcaaagctcgccctgcccgtttcggggcgtcgcacgcctggaggatggaggctgacgttattactgcttgcttctcctatagtggggttgttcggggtgttcgggcggaggaccaagctgccgtctggcaagccaggcttcgcccctggcncttctcgtcccgccctcnccttacgtcttcgcg

SEQ ID NO: 374072 - DNA, 610 bp, Homo sapiens
  misc_feature: GZ8MTXP01C4VVD.17.31.C09.1.454.CMB.2.raw
  modified_base (270)..(270): a, c, t, g, unknown or other
  modified_base (296)..(296): a, c, t, g, unknown or other
  modified_base (552)..(552): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagccnggccaagcccccaggacactgattangatacaaacaacaaacactctgacccctgccggttctcagctccctcggttcggggcaagcctgcccctgtcccctttcgggtgccgcacgccgtgacggatgaggctgagttattactgtcttgcttcgtcctagttaggttgggggttggtttcggggttggtttcggggacgggtacgggacccaaggtcgtcgaccgttccgtagggtcaacggccccgaaaggggccttccggtccccctcggggttcccnccgttcccgttccgttcccccgtcccttcccgtaccgttacgttccgttaaccgtccg

SEQ ID NO: 374073 - DNA, 578 bp, Homo sapiens
  misc_feature: GZ8MTXP01AIG4G.17.31.C09.1.454.CMB.2.raw
  modified_base (270)..(270): a, c, t, g, unknown or other
  modified_base (478)..(478): a, c, t, g, unknown or other
  modified_base (522)..(522): a, c, t, g, unknown or other
  modified_base (538)..(538): a, c, t, g, unknown or other
  modified_base (553)..(553): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagccnggccaagccccccaggacactgatttatgataacaaacaaacaaacactacctggacccctgcccggttctcacggcctccctccggttcgggggcaaagctgcccctggccctttcggggtcgcgcgagcctgaggatgaggctggtagtattacgtgtcttgctctcctattacgtggggttggttcggggttggttcgggtcggngggaccgaagcgtcgtacccgtcgtaggtcaagtcccagggccncgccccgtcggttccncgttcctcgttcccnccctcctccttactccgttcgtccg

SEQ ID NO: 374074 - DNA, 636 bp, Homo sapiens
  misc_feature: GZ8MTXP01DQLBA.17.31.C09.1.454.CMB.2.raw
  modified_base (346)..(346): a, c, t, g, unknown or other
  modified_base (401)..(401): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtccccgaggaggacagtcattctcacctgtcggctccagcagtggagctgtcaccaatggtcattactccctactcggttaccaagagaacgcctcggacccaacgcccccaggacactgtatttanacgaactaaacaaaccaaacaaactacctccctcggcccctaggtccccggttcncgacggtccttcccgtcggtcggggacaagctcgcccgtacgtccgttcgggtcgcgcacgccgtaggaggggtagtcggaggtcgtagtacgttatttacgttcgtcgttcgtccttcctaccgttgttacgggtttggggttcgggtttcgggggttcgggtttcggggacgggttcgggaccgtaacggtcgtaaccgggtacccgtcggttacggtcccgcggtaacccgg

SEQ ID NO: 374075 - DNA, 528 bp, Homo sapiens
  misc_feature: GZ8MTXP01CLSSI.17.31.C09.1.454.CMB.2.raw
  modified_base (295)..(295): a, c, t, g, unknown or other
  modified_base (330)..(330): a, c, t, g, unknown or other
  modified_base (386)..(386): a, c, t, g, unknown or other
  modified_base (495)..(495): a, c, t, g, unknown or other
  modified_base (507)..(507): a, c, t, g, unknown or other
  modified_base (513)..(513): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggcagtcactctcacctgtggctcagcactggagctgtcaccaatggtcattactccctatggttccaacagaagcctggccaacgcccccaggacactgattangatacaaacaacaaacactcctgacccctgccgtntcagctcctcgttgggggcaaagctgccctgcccgttcgggtgcgcagcctgagangaggctgatattactgcttgctctcctatgttggggtgttgggtgttcgggcggaggaccgaaggctcgtaccgtccgtgtcaacgcccaggccttcgcccctggttcncttctcgtcccncctccncttactcgttcgtcg

SEQ ID NO: 374076 - DNA, 606 bp, Homo sapiens
  misc_feature: GZ8MTXP01B4HOB.17.31.C09.1.454.CMB.2.raw
  modified_base (437)..(437): a, c, t, g, unknown or other
  modified_base (551)..(551): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggaccaacgcccccaggacactgatttatgactacaaaacaacaaacacctcctacggacccctcgcccggttctccgacggcctcccgtaccggttcgggggacaaagcctcgcccctcgtaaccccgtttcgggtgcccgcagcccgtaggacgagtggaacgggngtagtagttattacgtcgtcttgccttctacttagttggttgggggttggtttcgggtggttcgggacggacggaccgagtcgtcggtaccgttcgacgcgaacgccgagtccnccgccccgtcgttccttcttcctcctcccctccctcctccttacgtccgttcgtg

SEQ ID NO: 374077 - DNA, 643 bp, Homo sapiens
  misc_feature: GZ8MTXP01ASTJU.17.31.C09.1.454.CMB.2.raw
  modified_base (264)..(264): a, c, t, g, unknown or other
  modified_base (267)..(267): a, c, t, g, unknown or other
  modified_base (603)..(603): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatgtccaacagaanccnggccaagcccccaggacactgatttatgataacaaacaacaaacactcctcggaccccctcggtcccgttctcgacgtcctcccgttcgggtcggggacaacgtccgtccgtccccgttacgttccccggttcgggtcgccgcgacgtccgtagggacgtagtggacggcgtaggtagttattacgtgttcgttcgtccttcctacgttaagttgggttgggggtttcggggtttcggggttcgggttaccggggacgggtaacgggaccgtaagtccgtacgtacccgtcgtacgtcgaaccgtaccgacgtccgttcccgtccccgtcgttacnccttccgtccctcccctccctccctacgttactcgcgtcg

SEQ ID NO: 374078 - DNA, 651 bp, Homo sapiens
  misc_feature: GZ8MTXP01BF4CP.17.31.C09.1.454.CMB.2.raw
  modified_base (261)..(261): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccgaggaggacagtcactctcactgtgctcagcactgganctgtcaccaatggtcattactcccctactcggttacccaacagaacgcctacggaccaacgcccccaggacactgatttagacgaactaacaaacaaaccaaacctaacccttacccgtccggtaccccctcggtcccccggttctaccgacgggtccttacccccgtcgggtttacgggggactaaacggccgtaccggcccgtacggtaccccgtttcgggtcgccgcgacgtccgtggacggggtagtcggtacgttcgtgtagttattaccgtgtcgttcgtccttcttccgttaagttggttgggttcgggtttcgggtacggttcgggacgggttacggacgaaggtctaacgggaccgttcgttacgggtcaacggtaacccg

SEQ ID NO: 374079 - DNA, 533 bp, Homo sapiens
  misc_feature: GZ8MTXP01AQRXJ.17.31.C09.1.454.CMB.2.raw
  modified_base (428)..(428): a, c, t, g, unknown or other
  modified_base (456)..(456): a, c, t, g, unknown or other
  modified_base (498)..(498): a, c, t, g, unknown or other
  modified_base (500)..(500): a, c, t, g, unknown or other
  modified_base (525)..(525): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttcccaacagaagcctgggaccaagccccccaggacactgatttatgatacaaacaaacaaacaactcctcggacccctggcccggttctcgaggctccctcgttgggggcaaagctgccctgacccttttcgggnccgcagcctgaggggatgaggctgagtntactgtctgctctcctaatggttggtggttcggtgttcgggngngggacccaagctgaccgtcaggtcngaaccccg

SEQ ID NO: 374080 - DNA, 523 bp, Homo sapiens
  misc_feature: GZ8MTXP01EVFE3.17.31.C09.1.454.CMB.2.raw
  modified_base (246)..(246): a, c, t, g, unknown or other
  modified_base (265)..(265): a, c, t, g, unknown or other
  modified_base (268)..(268): a, c, t, g, unknown or other
  modified_base (376)..(376): a, c, t, g, unknown or other
  modified_base (405)..(405): a, c, t, g, unknown or other
  modified_base (490)..(490): a, c, t, g, unknown or other
  modified_base (502)..(502): a, c, t, g, unknown or other
  modified_base (508)..(508): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattanccctatggtccaacagaanccnggccaagcccccaggacactgattatgatacaaacaacaaacactcctggacccctgcccggttctcagctcctcgttgggggcaaagctgccctgccctttcgggtncgcagcctgagatgaggctgagtattacngctgctctctatagtggggtgttcggggtgttcggcggaggacaagctgtaccgtcctagcaagcccaaggcttcgcccctggcncttcctctcccnccctcncttagtcttaacgcg

SEQ ID NO: 374081 - DNA, 546 bp, Homo sapiens
  misc_feature: GZ8MTXP01CFVJL.17.31.C09.1.454.CMB.2.raw
  modified_base (266)..(266): a, c, t, g, unknown or other
  modified_base (269)..(269): a, c, t, g, unknown or other
  modified_base (296)..(296): a, c, t, g, unknown or other
  modified_base (442)..(442): a, c, t, g, unknown or other
  modified_base (466)..(466): a, c, t, g, unknown or other
  modified_base (476)..(476): a, c, t, g, unknown or other
  modified_base (510)..(510): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaanccnggccaagcccccaggacactgatttangatacaaacaacaaacactcctggacccctgccccggttctcacggcctcccgttccggttcgggggacaaaggcctcggccccttggtccccgtttcggggtcgcgcagcccgtgacggatgaggctgagtattactgcttgctntctatgtgggtgttcggtgtcggnggaggcagcngccgtctagtcaagccaggcttcgccccctggcncttctcgtcccaaccctctccttagtccttaacgcg

SEQ ID NO: 374082 - DNA, 672 bp, Homo sapiens
  misc_feature: GZ8MTXP01BUCDE.17.31.C09.1.454.CMB.2.raw
  modified_base (346)..(346): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcacgtggagctgtcaccaatggtcattactcccctactcggttaccaacagaacgcctggacccaacgcccccaggaccactgtatttanacgaataacaaacaacaaacaactcctcggacccctcgcccgttctcgacggtctcccgtcggttcggggacaacgcgtcgccctacgtacccgtttcgggtcgcgcgacgccgtaggacggggtacgttggacggtcgtaggtacgttacgtttacgtcggtccttcggtcctttccgttcccgttaagtttaccgggtttggggttttcgggtttccgggggttcgggtttaccgggggcggggttacggggacccgtaaagggtcccgttaaccgggtaccccggttcccgttacggggttcccgaaccgggtaacccccggg

SEQ ID NO: 374083 - DNA, 794 bp, Homo sapiens
  misc_feature: GZ8MTXP01B6RQ5.17.31.C09.1.454.CMB.2.raw
  modified_base (269)..(269): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgcccctcactgactgtcgtccccgagggaggacagtcactctcacctgtggctccgagcacgtgganctgtaccaacctaagtgtactaatttacctacccttacgtcggttaccccaaagtacggaacgtcccgtacggaccccaacccggccccccgaaggacctacgtagtactttaagtaccgaaactaaacaaaaaccaaacaaaaccctaaccttaccccgtaacccggtacccccgtcgggtacccccggtttactacccgtaaccgggtccccttcccccggttacggggttaccgggggaacctaaaccggtccgtacccggtccccgttaccgggttacccccgggtttcggggtccggaccgtaccgaaccggtcccgttagggacgggggtaggttccgggaaggtccgttaggtaacgtttacgttacgttcggtcttccgaccgtttccgtcgttaaggttggttcgggggtttcgggtttcgggggtacgggtccggggttacgggggttacgggacccgtaaggtccggtaacccggtacccgggttaccgacgggttccgaaccgtaaccccggg

SEQ ID NO: 374084 - DNA, 566 bp, Homo sapiens
  misc_feature: GZ8MTXP01CLE3W.17.31.C09.1.454.CMB.2.raw
  modified_base (270)..(270): a, c, t, g, unknown or other
  modified_base (492)..(492): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagccnggccaagcccccaggacactgatttatgatacaaacaacaaacactcctcggacccctgcccggttctcaggctccgtccgttgggggcaagctcgccctcgcccgttcgggtcgcgcagcctgacggatggaggctggagttattactgtcttgctctcctatacggtggggtggttcggggtgttcgggcggtaggaccgagcgtcgtccgtcgtggtcncgcccgaggccttcgccccgtcggttccttcttcctccgttcccaacccttcctccgttacgtccgttcgtccg

SEQ ID NO: 374085 - DNA, 600 bp, Homo sapiens
  misc_feature: GZ8MTXP01BDEK3.17.31.C09.1.454.CMB.2.raw
  modified_base (266)..(266): a, c, t, g, unknown or other
  modified_base (304)..(304): a, c, t, g, unknown or other
  modified_base (340)..(340): a, c, t, g, unknown or other
  modified_base (369)..(369): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcgaggacgccctcactgactgtcgtccccgaggaggacagtcactctcactgtcggctcagcacgtgganctgtcaccaatggtcattactccctactggttaccaanagaacgcctgccaacgcccccaggacactgatttanacgataaacaaacaaacaaacaactcccncggacccctcgtcccgtctcgacggtctcccgtggtcggggacaacgctcgccctcgtacccgtttcgggcgcgcgacgccgtggaggggatggacggtcgtagtacgtattacgtgtcttgtcctcttcctaagttcggttgggttcggttcggggtggttcggggacgggttcgggaccgaaggtccgtaacggtacccgtcgttacgggtcgttaaccggaacccggg

SEQ ID NO: 374086 - DNA, 729 bp, Homo sapiens
  misc_feature: GZ8MTXP01EHHKP.17.31.C09.1.454.CMB.2.raw
  modified_base (316)..(316): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggaggacagtctactctctacgtgtcgctcgagcacgtggacgctgtaccaacctaagtcggtactattacctaccctagttcggtaccaanagacgtccgtcgaccaacccgaccccgaggactacgtagttaatttagacgtaactaaaacaaaaaccaaactaaacctaacccttacccgtcccgaacccgtcgggtccccgttctacggacggtcccgttcccgtgggggttacggggaactaacggtcctccgtcccgttaccggttcccggtttcgggcgccgacgacgtccgtagggaacggtagtggggacgtcgtagtacgttaacttcgtcggtcttcggtccttcccgttccggtaaagttccggggtttggggtttcggggtttccggggttacggggttcccggggacgggggttaaccgggaaaccggtaacgggtcgttaaccggtaccccggtacggttacgggtaacccgttaacccggaaccccggg

SEQ ID NO: 374087 - DNA, 607 bp, Homo sapiens
  misc_feature: GZ8MTXP01BCCLS.17.31.C09.1.454.CMB.2.raw
  modified_base (226)..(226): a, c, t, g, unknown or other
  modified_base (297)..(297): a, c, t, g, unknown or other
  modified_base (560)..(560): a, c, t, g, unknown or other
  modified_base (571)..(571): a, c, t, g, unknown or other
  modified_base (577)..(577): a, c, t, g, unknown or other
  modified_base (584)..(584): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatgtcattactccctatggttccaacagaagcctggccaacgcccccaggacactgatttangataacaaacaaacaaaacactcctacggaccccctcgtccccggttctacgacggcctcccgtccggttgggggacaaaggcctcgccccgtcgtccccgtttcgggtcgccggcaacggtcccgtggacggatggaacggtcgtagtagtatttaacgtgtcgttgcctcttcctaagttcggttgggggttggtttcggggttgtttcgggacgggaacggacgaagcgtcgtaccgtccgtaggtcaacgaccgagccncgcccgtcgcncgttcncgtcccnccctctccttcgtcttaacgtcg

SEQ ID NO: 374088 - DNA, 617 bp, Homo sapiens
  misc_feature: GZ8MTXP01BLBDY.17.31.C09.1.454.CMB.2.raw
  modified_base (263)..(263): a, c, t, g, unknown or other
  modified_base (338)..(338): a, c, t, g, unknown or other
  modified_base (384)..(384): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattactccctactggttccaacagaacgcctggccaacgcccccaaggacactgatttancgataacaaacaacaaacaacctcctcggacccctcgcccggttcncgacggcctcccgtcggttgggggacaacggctcgacccttcggtaccccgttttcgggcgccggcacggccgtggacggggagtgggaggtcgtaggtagttagtttacgtcggtccttggtccttcttccgttaagtgggttgggttcggtttcggggttcggttcggggcgggggttacgggaccgaaggtccgtcggtcccggtcgttacggtccgaacggtaaccccg

SEQ ID NO: 374089 - DNA, 641 bp, Homo sapiens
  misc_feature: GZ8MTXP01DDE2A.17.31.C09.1.454.CMB.2.raw
  modified_base (269)..(269): a, c, t, g, unknown or other
  modified_base (297)..(297): a, c, t, g, unknown or other
  modified_base (338)..(338): a, c, t, g, unknown or other
  modified_base (400)..(400): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagccnggccaacgccccccaggacactgattangatacaaacaacaaacactcctcggacccctgcccggttcncagctcccgtcgtgggggacaagctcgcccctgtcccgtttcgggtcgcgcacgcctgaggntgaggctgagttattactgtcttgctctctagtaggttggggttgtttcggggtgtttcggggacggtacggggaccaaggtccgtcggtacccggttccgtacgggtccgaaccggacccgaaacggggtcccttcccgggtcccccccgtttcggggttaccccttccgttcccgtttccccggttccccccgtccccctttccccgttcccgttacgttcccgttaaccggtcccggg

SEQ ID NO: 374090 - DNA, 687 bp, Homo sapiens
  misc_feature: GZ8MTXP01BC3TG.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtccccgaggaggacagtcactctcacctgtcggctccagcactggagctgtcacctaatcggtctattactccctactcggtaccaacagaacgcctcggacccaacgcccccgaggacctactgtatttagtacgaactaacaaacaaaccaaaccaacctcccgtccgacccctcggccccggttctaccgacgggtcccttacccgtcgggttacgggggaccaaacgtcgtacgtcccgtaccgtaccccggtttcgggcgccgactacggccgttagggacggggtagtacgggtagtcgtagtaacgttacgtttactcggtcttcggtccttccgttccttaaggtcgggtttggggttcggtttcgggggttcggtttcggggaccggggacgggttaaccgtaacgggtccgtaacggtacccggtacggttacgggaaccgttaaccgggaaccccgg

SEQ ID NO: 374091 - DNA, 714 bp, Homo sapiens
  misc_feature: GZ8MTXP01BRB3W.17.31.C09.1.454.CMB.2.raw
  modified_base (298)..(298): a, c, t, g, unknown or other
  modified_base (341)..(341): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctatggttccaacagaacgcctggccaacgcccccaggacactgattangataacaaaacaacaaacactcctacggacccctgcccgttcncgacgcctccgtcggttcgggggcaaagcctcgccctcgtcccgttcgggtcgcgcacgccgtggacgagtggaggtctggtaagttattacgtggtcttcgccttcctaccgttaagttcggttgggggtttcggggtttcgggggttcgggtttccggggaccggggtaacggggtaacccgtaacgggtacgttaccggtacccgggttacccgtacgggttccgtaaccggtccccggaaacgggtcccgttacccggtcccccccggttacgggttccccttcccgtttaccccgttcccggttcccccccgttaaccccctttccccgttaccccgttaaccggttccccgttaaccggtccccggg

SEQ ID NO: 374092 - DNA, 643 bp, Homo sapiens
  misc_feature: GZ8MTXP01DAKC2.17.31.C09.1.454.CMB.2.raw
  modified_base (292)..(292): a, c, t, g, unknown or other
  modified_base (452)..(452): a, c, t, g, unknown or other
tcagcgtagactagcacgaccggtgctcgatttagacgtctcatcaaggaaggaagggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaaggcccggggagtctctgaggatctccgtgtaaggttctggatacgtaggttttccagtctacgtggatcgaccgtgggngcgccaaggaacgacccggtaaaggccgtgggagtggagtggggagattgatcccgagtcgactctacactatacaactaccacgtccgtccttaccgaacggcccacgtccaccactctacagctacgaactacgtccatacacgtactcgaccttccngtccaggtcgacgcgacggccgtgggaaccggcctacgggaccacccgtactattactacgttaccgtggtcgcggtaacggttcccggtttaagtcccggcccgtacgacgttaacgttccttaaacccgttaacttaaccgtaacggttaccggtccgttaggggtaaccggtttccggtaaccggggg

SEQ ID NO: 374093 - DNA, 540 bp, Homo sapiens
  misc_feature: GZ8MTXP01DNJ3N.17.31.C09.1.454.CMB.2.raw
  modified_base (297)..(297): a, c, t, g, unknown or other
  modified_base (380)..(380): a, c, t, g, unknown or other
  modified_base (506)..(506): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaacactacctggacccctgcccggttctcaggctcctcgttgggggcaaagctgccctgcccttcgggtncgcagcctgacggatgaggctgagtattactgcttgctctcgtaatgtggggtgttcgggtgttcggcggtaggacgaagctgaccgtcctaggtcaaggcccaagggcttcgccccgtcggttcncttcctgtccccgcctctcttacgtcttaacgcg

SEQ ID NO: 374094 - DNA, 790 bp, Homo sapiens
  misc_feature: GZ8MTXP01CMU0P.17.31.C09.1.454.CMB.2.raw
  modified_base (262)..(262): a, c, t, g, unknown or other
  modified_base (271)..(271): a, c, t, g, unknown or other
  modified_base (301)..(301): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcacaatggtcattactccctactgttaccaanagaacgccnggaccaacgcccccaaggacactgatttanagaactaacaaaacaaacaaacactccgtacggtaccccctgtcccggttctccgacggtcctcccgtcggttacgggggacaacggtcctcggtaccccgttcggttccccggtttcggggtcgccggtctacggccgtagggaacgggagttgggacgggtcgttagggtaacgtttaacgtttaccgttcggtctttccggtccttacccgtttaccgttaggtttacggggtttcggggggtttcggggttttccgggggtttacgggtttcccgggggacggggtaaaccggggtaacccggtaaacgggttcccgtaccgggtaaccccggttcccgttaaacggggttcccgaacccggtaccccggttaaacgggttccccgttcccggtccccccgtcgggttcccttacccgttcccggtttcccgtttcccccgtaacccctttcccgtcccgttaccggtcccttaaccggttccgg

SEQ ID NO: 374095 - DNA, 704 bp, Homo sapiens
  misc_feature: GZ8MTXP01ARYG8.17.31.C09.1.454.CMB.2.raw
  modified_base (226)..(226): a, c, t, g, unknown or other
  modified_base (272)..(272): a, c, t, g, unknown or other
  modified_base (300)..(300): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattactccctactggttaccaacagaagccnggccaacgcccccaggacactgatttangataacaaacaacaaacactcctcggacccctcgtcccggttctcgacggtcctcccgtccggtgggggacaagcctacgcccgtcgtcccgtttcgggcgacgtcgacgccgtgggacggagtacggaggtcgtaggtaagttacttacgtcggtctttcggccttactccgttaagtcgggtttcggggggttcgggtttcgggggttcggttaccggggacggggacgggtaacccgtaggtaccggttacggtaccccggttacggtaacgggtcccgaacggaaccccgttaacgggtccccttcccgggccccccgttcggttccccttaccggttcccgttccccgttcccccggtccctttcccgtcccgttaacgtttcccgttaaccgtccggg

SEQ ID NO: 374096 - DNA, 654 bp, Homo sapiens
  misc_feature: GZ8MTXP01EPQUG.17.31.C09.1.454.CMB.2.raw
  modified_base (261)..(261): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtgctcagcactgganctgtcaccaatggtacattactccctactcggttaccaacagaacgcctggacccaacgcccccaggaccacgtgaatttatacgaataacaaaacaaacaaacaactccctcggacccctgccccggttctccgacggtcctcccgtcggttacgggggacaaacggctacgcccgttacggtaccccgtttcggggtcgccgcaacgccgtggagggggtagtggaggtcgtaggtaacgtattacgtcgtcttcggtcttcctccgttaagttcggttggggttcggtttccggggttgggtttccggggacggggttacggggttaacccgtaagggtcccggtcggtaacccggttcccgttacgggtccgttaacggtaacccccgg

SEQ ID NO: 374097 - DNA, 587 bp, Homo sapiens
  misc_feature: GZ8MTXP01AZ1QC.17.31.C09.1.454.CMB.2.raw
  modified_base (339)..(339): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtcattactcccctactcggttccaacagaagcctggccaacgcccccaggacactgatttancgatacaaaacaacaaacaactccctcggacccctgcccgttctcgacggctcccgtcggttggggcaagctcgccctcgtacccgtttcgggtcgcgctagcctggaggggctggaggctgagtattacgtgtctgtctctccttaagtcggttggttggttccgggttgggttccggggacgggacggggttacccgaaggtccgtaacggtacccggttccgttacgggtccgaacggaaccccg

SEQ ID NO: 374098 - DNA, 620 bp, Homo sapiens
  misc_feature: GZ8MTXP01EF55K.17.31.C09.1.454.CMB.2.raw
  modified_base (445)..(445): a, c, t, g, unknown or other
  modified_base (470)..(470): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcgaggacgccctcactgactgtcgtcccgaggaggacagtcactctcacctgtcggctccagcactggagctgcacaatggtacattactcccctacgtcggttacccaaacgacgaacgcctacggacccaaccgcccccaggactactagtactttatacgactaaacaaaacaaaccaaaccgaacctacccgtcggacccctcgccctacgtcctacgacgtccctcccgtcggtgggacaagcncgtccgtcgtaccgttcgggcgcgngacgtccgtaggggacggtagtcgaggcttggagttattacgtgtccttcgtcttcgtaacgttagttgggttcggttgggttcgggttcggttacggggcgggacggtaaccgagtcgtacggtacccgttcgtaacggttcgaaccgg

SEQ ID NO: 374099 - DNA, 588 bp, Homo sapiens
  misc_feature: GZ8MTXP01EBB5N.17.31.C09.1.454.CMB.2.raw
  modified_base (300)..(300): a, c, t, g, unknown or other
  modified_base (345)..(345): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtcccgaggagggacagtcactctcactgtgctccagcactggagctgcacaatgtcattactccctactcggttacccaaanacgaaacgcctacggacccaacgcccccaggaccactgaatttanacgaataacaaaacaaacaaacaacctaccctcggacccctggccccgttctccgacgggtccttcccgtcggttaggggacaacgctacggcccgtcgtacccgtttcgggcgcgcagccgtggagggatggaggctagtaagtagttacgtgtcgttgcttcctctaagttggttgggttggttgggtgggttcgggcgggttggacccaagtcgtcgccgtcgttaggtccaacggcccg

SEQ ID NO: 374100 - DNA, 583 bp, Homo sapiens
  misc_feature: GZ8MTXP01ADJXG.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtggctccagcactggagctgtcacaatggtcattactccctactcggttccaacagaacgcctggaccaacgccccccaggactactgactttagacgaataacaaaacaaacaaacgaacctacccgtcgaccccctacgtccccggttactccgacgggccttacccgtcggttcgggggacaaagccgtcgccctcgtacccgttcgggtcgccgcacgccgtgaggggatgaggcgtgagtatacgtgtctgtctctcctaagtgttgggtgttcgggtggttcgggcggttagggacaaggcgtcgtaccggtcttacggtcgcgtaacccg

SEQ ID NO: 374101 - DNA, 593 bp, Homo sapiens
  misc_feature: GZ8MTXP01ECH8Y.17.31.C09.1.454.CMB.2.raw
  modified_base (226)..(226): a, c, t, g, unknown or other
  modified_base (305)..(305): a, c, t, g, unknown or other
  modified_base (565)..(565): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattactcccctactggttcccaaacagaacgcctggaccaacgccccccaggacactgatttanagaataacaaaacaaacaaacactccgtacggaccccctgtcccggttctcgacggtcctcccgttcggtcgggggacaaagcctcgcccctcgtcccgtttgggtcgcgctacgccgtggacgatggaggctgagttattacgtgtcttgctctctagtggttggggtgttcggggtgttcgggcggtaggaccgagctgtccgtcgtagcaagccgaggtccttccgccccgtcgttcgttctttccgtccgttcccncccttacctccgttacgtccgttcgtcg

SEQ ID NO: 374102 - DNA, 602 bp, Homo sapiens
  misc_feature: GZ8MTXP01A2YCI.17.31.C09.1.454.CMB.2.raw
  modified_base (267)..(267): a, c, t, g, unknown or other
  modified_base (308)..(308): a, c, t, g, unknown or other
  modified_base (388)..(388): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtccccgaggagggacagtcactctcacctgtcggctccagcactgganctgtcaccaatggtcattactccctacgtggttacccaaanagaacgcctggacccaacgcccccaggacactgattacagactaacaaacaaacaaacactcctcggccctgcccgttcncgacgtctcccgtgggttcgggactaacgcgtcgtacccgtcgtacccgtttcgggcgcgcacgcgtgaggggagtggacgtgtagtagtattacgtgtcttcgccttctccgttaagttcgggttgggttggttccggggtggttccggggacgggttacgggaccgaaggtctccgggtacccgtcggttacggccgttaacggtaaccccg

SEQ ID NO: 374103 - DNA, 576 bp, Homo sapiens
  misc_feature: GZ8MTXP01BS3UD.17.31.C09.1.454.CMB.2.raw
  modified_base (341)..(341): a, c, t, g, unknown or other
  modified_base (383)..(383): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccgaggagggacagtcactctcacctgtcggctccagcactggagctgtcaccaatggtcattactccctactggttaccaacagaacgcctggccaacgcccccaggacactgatttancgataacaaacaacaacaacctcctcggaccctgcccgttcncgacggctcccgtcggttgggacaagctcgccctcgtacccgtttcgggcgcgcagcctggaggggtgtggaggctgaacgttagttacgtgtcttgcttctcctaagtggttggggttgttcggggtggttccgggaggggttcggaccgtaaggcgtcggtacccgtcgttaggtaaccgcggtaacccgg

SEQ ID NO: 374104 - DNA, 628 bp, Homo sapiens
  misc_feature: GZ8MTXP01ASI2T.17.31.C09.1.454.CMB.2.raw
  modified_base (170)..(170): a, c, t, g, unknown or other
  modified_base (299)..(300): a, c, t, g, unknown or other
  modified_base (409)..(409): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctnactgactgtgtccccaggagggacagtcactctcacctgtggctcagcactggagctgtcacaatggtcattatccctactggttccaaacagaagcctggcccaagccccccaggaccactgatttannactaacaaacaacaaacactccgtcgaccctcgtccgtctacgacggtcctccgtccggtcggggacaacgcgtcgtcccgtcggtcccgtttcgggcgcgcacgtcgngaggatggaggcgtagtaagttattacgtgtcttgccttcttacgttagtaggttgggggtttcggttcggggttcggttaccgggacgggacggaaccgaaggtcgtacggtacccgtccgtacggtccaacggcccgttaacgggccttcccggccccgttcggttccttcgttccgttcccgttccccgcccgttccctaccgttctccgttcgcg

SEQ ID NO: 374105 - DNA, 537 bp, Homo sapiens
  misc_feature: GZ8MTXP01BI5TS.17.31.C09.1.454.CMB.2.raw
  modified_base (295)..(295): a, c, t, g, unknown or other
  modified_base (388)..(388): a, c, t, g, unknown or other
  modified_base (498)..(498): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaagcccccaggacactgattangatacaaacaacaaacactcctgacccctgccggttctcaggctcctcgttggggcaaagctgccctgcccgtttgggtgcgcagcctgaggntgagctgagtattactgcttgctctctatacgtggggtgttcggggtgttcggcggaggccaagctcgaccgtctaggtcaagtcccaagggccttcgcccctcggttcncttctcgttccccaacctcctccttacgtccttaacgcg

SEQ ID NO: 374106 - DNA, 641 bp, Homo sapiens
  misc_feature: GZ8MTXP01C0W5A.17.31.C09.1.454.CMB.2.raw
  modified_base (273)..(273): a, c, t, g, unknown or other
  modified_base (307)..(307): a, c, t, g, unknown or other
  modified_base (354)..(354): a, c, t, g, unknown or other
  modified_base (404)..(404): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatcggtacattactccctactggttacccaacagaacncctggaccaacgcccccaaggactactgatttanagaactaacaaaacaacaaacactacctcggacccctgcccggttcncgacgctcccgtcggtggggacaagctcgcccttacgtcccgtttcgggntccgcgtacgctgaggctggaggctagagttatacgtgtcttcgacctcttccgtaagttgggtggggttcggttcggggtggttcgggacgggtacgaccgagccgtcgtaccgtcgtacggtccaacggtacccgaaaggtcccttcggtcccccgttcggttacccttaccgttcccgttcccgttaccccctccccgttccttcccgttaacgttccgttaacccggtaaggg

SEQ ID NO: 374107 - DNA, 584 bp, Homo sapiens
  misc_feature: GZ8MTXP01CBDX6.17.31.C09.1.454.CMB.2.raw
  modified_base (345)..(345): a, c, t, g, unknown or other
  modified_base (541)..(541): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtcattactcccctactggttacccaacagaacgcctgggcccaaacgcccccaggaccactgatttancgatacaaacaacaaacaactcctcggacccctgccccggttctcacgggcctcccgtcggttgggggacaaacgctcgccctcggtacccgtttcgggtcgcgcacgtccgtgacggggtagtggacggtctgagttattacgtgtcgttgtcttctcctaagtcggttggttggttcgggttggtcgggcgggnggttaccgaaggcgtcgaccgtcgttacggtcgaacgaacccg

SEQ ID NO: 374108 - DNA, 827 bp, Homo sapiens
  misc_feature: GZ8MTXP01BB2RN.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccagggagggacagtcactctcacctgtggcctcagcacgtggagctcgtaccaacctaagtggtactattacctccccttacgttcggttacccaaacgtagaaacgtcccgtcggacccaaaccgccccccgaaggacctaccgtagtaatttatacgaaactaaaccaaaacaaaccaaaacctaccttcccgtaccggtaaccccccgttcggtccccggtttacctaccgaacggtccccttaccccggttccggggttacgggggaacctaaacggtccgtaccggtccccgtaccggttccccgggttttcgggccgccgacgtacggtccgttagggaacggtacgtggaacggtcgtaggtaacgttactttacggtcgttcgttcggtccttcttaccgtaagtttcgggttgggggtttcgggtttcggggttcggtcggggtacgggtacggaccgtaaggtcgtaccggtacccggttacgtacggtccgaacggtaaccccgttacgggtcccgttccccggtccccggttcccggttacccgttcccgttccccgtttccccggtttacccccccggtcccctttccccgtaccccggtttccgttaacccgttaacccggttcccggg

SEQ ID NO: 374109 - DNA, 601 bp, Homo sapiens
  misc_feature: GZ8MTXP01AD0JF.17.31.C09.1.454.CMB.2.raw
  modified_base (270)..(270): a, c, t, g, unknown or other
  modified_base (299)..(299): a, c, t, g, unknown or other
  modified_base (556)..(556): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaacgccnggaccaacgcccccaggacactgatttangataacaaacaacaacactcctcggacccctggcccggttctcgacggtcctcccgtcggttcggggcaaagctcgaccctcgtaacccgttcgggtcgcgacgacgtcctggagagtgacggcgtagtagtattactgtcttgcttctctagtggtggggttggttacggggttcggttcgggaggacgggacccaggtcgtacggtccgtcgtacggtcgaacgcccgttaagccgttccgccccgtggttaccnccttccgtcctccccaacccttcctaccgttcgtcgttaaccgcg

SEQ ID NO: 374110 - DNA, 538 bp, Homo sapiens
  misc_feature: GZ8MTXP01ADBC7.17.31.C09.1.454.CMB.2.raw
  modified_base (297)..(297): a, c, t, g, unknown or other
  modified_base (477)..(477): a, c, t, g, unknown or other
  modified_base (501)..(501): a, c, t, g, unknown or other
  modified_base (513)..(513): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaacactcctgacccctgcccggttctcaggctccctcgttgggggcaaagctagccctgccctttcggggtcgcgcagcctgagatgaggctgagtatactgcttgctctctataggtggggtgttcggggtgttcgggcggaggaccaggctgtccgtctaggtcncgccgaggcttcgccccgtggccncttctcgttccnccgtccctccttcgtcgttcgtccg

SEQ ID NO: 374111 - DNA, 622 bp, Homo sapiens
  misc_feature: GZ8MTXP01E0DH1.17.31.C09.1.454.CMB.2.raw
  modified_base (269)..(269): a, c, t, g, unknown or other
  modified_base (297)..(297): a, c, t, g, unknown or other
  modified_base (433)..(433): a, c, t, g, unknown or other
  modified_base (568)..(568): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagccnggccaacgcccccaggacactgatttangataacaaacaacaaacactcctcggacccctgccccggttctcacggtcctccgtccggttacgggggacaaacggcctacggccccttcggtaaccccgttttcggggcgccgcgacggtcccgtggaacggtntggaggtcgtgagttattaccgtgtctgtcttctctagtgttggggttggtttcggggtggttcgggcgggaggaccaaggtcgtcgtaccgtcgtaggtcaacggcccgaggtccttaccgccccgtcggttcncccgttcctccggttccccgcccttccctccgttacgttccgttaaccgtcggg

SEQ ID NO: 374112 - DNA, 590 bp, Homo sapiens
  misc_feature: GZ8MTXP01BHMRH.17.31.C09.1.454.CMB.2.raw
  modified_base (342)..(342): a, c, t, g, unknown or other
  modified_base (389)..(389): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtccccaggaggacagtcactctcacctgtggctccagcactggagctgtcaccaatggtcattactccctactggttaccaacagaacgcctggacccaacgcccccaaggacactgatttanacgataacaaacaacaaaccaactcctcggacccctcgcccggttcncgacgcctcccgtcggttggggcaaacgctcgccctcggtacccgtttcgggcgcgcgacgccgtgaggggagtggagtctggtagttattacgtgtcttgtccttctctaagttacggttggggtttcgtttcggggtggttcgggcggggacggaccgaaggtcgtaacggcccgttcggttacggtcgaacggtcccg

SEQ ID NO: 374113 - DNA, 644 bp, Homo sapiens
  misc_feature: GZ8MTXP01CVNBH.17.31.C09.1.454.CMB.2.raw
  modified_base (227)..(227): a, c, t, g, unknown or other
  modified_base (275)..(275): a, c, t, g, unknown or other
  modified_base (303)..(303): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcacgtgganctgtcaccaatggtacattactccctactcggttaccaacagaacgcncgaccaacgccccaggacactgtattanagataacaaacaacaaacactcctcgacccctgcccgttctcgacgtcctccgtcggtcggggacaacgctcgcccgtcgtcccgttcgggtcgcgcacgcgtagagtgtgaggtctaggtacgttagtacgttcgtcttcgtcttcttcgttagttacggttgggggtttcgggtttcgggggtttcggttaccgggggacgggtaacgggaaccgtaggtccgtacggtacccggtccgtacggtccgaaccggtaccgacggtccgttcgtcccgtcccgttacggttccttaccgttcctcccgttcccctacccgtccttaccgttcgttccgtcg

SEQ ID NO: 374114 - DNA, 566 bp, Homo sapiens
  misc_feature: GZ8MTXP01DML5S.17.31.C09.1.454.CMB.2.raw
  modified_base (270)..(270): a, c, t, g, unknown or other
  modified_base (298)..(298): a, c, t, g, unknown or other
  modified_base (320)..(320): a, c, t, g, unknown or other
  modified_base (339)..(339): a, c, t, g, unknown or other
  modified_base (386)..(386): a, c, t, g, unknown or other
  modified_base (484)..(484): a, c, t, g, unknown or other
  modified_base (518)..(518): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgtcccagggtccaattcccaggctgtggtgactcaggagccctcactgactgtgtccccaggagggacagtcactctcacctgtggctccagcactggagctgtcaccaatggtcattatccctatggttccaacagaagccnggccaagccccccaggacactgatttangatacaaacaacaaacactccncggacccctgcccggttcncagcctcctcggttggggacaaagctgcccctgtcccgttcgggtcncgcagcctgagatgaggctgagttattacgtgtcttgcttctctataggtggggttgttcggggtgttcgggcggtaggacaagcgtcgtaccgtcgngtcaacgcccaggccttccgtccccgtggttccncttccgtccgttccccaacccttcctccgttacgttccgttaacgtcg

SEQ ID NO: 374115 - DNA, 708 bp, Homo sapiens
  misc_feature: GZ8MTXP01DE8BY.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctggtggtgactcaggacgccctcactgactgtgtccccaggagggacagtcactctcactgtcggctccagcacgtggagctgtccacaatggtactattactcccctacgtcggttaccaacgagaacgccgtacggaccaaccggcccccaggaccacgttgtatttatacgaaacttaaacaaaactaaaaccaaaccctaaccttacccgtccgggtaaccccctcgggtacccccgggttactccgtacggtccctcccggttccgggttggggaccgtaaacgtcgtcggtccccgtacggtaccccggtttcgggtcgccggcgacgaccgttaggaggggtagtgggacggacgttggtaagttaacgtttacgtcgttctttcggtccttccgttaccgttaagtcgggttttcgggtttcgggttcggggtttcgggttccggggttacgggacggggttaaccgaacggtacgtcggtacccggtcgttacgggttccgccggtaacccgg

SEQ ID NO: 374116 - DNA, 749 bp, Homo sapiens
  misc_feature: GZ8MTXP01CA9EX.17.31.C09.1.454.CMB.2.raw
  modified_base (225)..(225): a, c, t, g, unknown or other
  modified_base (265)..(265): a, c, t, g, unknown or other
  modified_base (268)..(268): a, c, t, g, unknown or other
  modified_base (297)..(297): a, c, t, g, unknown or other
  modified_base (337)..(337): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccaggtccaattcccaggctgtggtgactcaggagccctcactgactgtgtccccaggagggacagtcactctcacctgtggctccagcactgganctgtcaccaatggtcattatccctatggttccaacagaanccnggaccaacgccccaggacactgtatttanagataacaaacaacaaacactcctcgaccctgcccgttcncgagcctccctccggtcggggacaacgctcgccctcgtcccgtttcgggtcgcgcgacgccgtaggacggactggacggtcgtagtaacgttagtacgttcggtcttcgccttcgttaccgtaagtttagggttcgggggttcggggttttcccgggggttagggtttcccgggggcggggtaaacgggggaccccgtaaaggtacccgggtttccgggtaaaccccggtttcccggtttaacgggtcccgtaacccgggaaccccggttaacgggggtcccccttaccgggtacccccccccgttgggtttaaccccttccggtttcccccgtttcccgggtttacccccccctccccggttttcccctaccccgtttaccggttaaccccgttaacccgggtccccgggg

SEQ ID NO: 374117 - DNA, 651 bp, Homo sapiens
  misc_feature: GZ8MTXP01C7RXV.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccagggagggacagtcactctcacctgtggctcatcactggagctgtcaccaatggtcattactccctactggttccaacagaagcctggccaacgccccccaggacactgatttatagataacaaaacaaacaaaacactcctacggaccccctcgtcccggttcttacggtcctccgtcggttcgggggacaaagtcgtacgcccctacgtacccgtttcgggtcgccgcacgccgtggacggagtgaggtctggagttatacgtgtcgttcgtctctaccttagttaggttgggttggggtttcggggttcggttcggggtcgggacgggaccgaaggccgttacggaccgttccgtaggtccgcggaacccgtaacggccctcccggttccccgtccggtccttaccgttcccttccgttcccccgtccccttcccgttccgtacgttcctaaccgcgttcggg

SEQ ID NO: 374118 - DNA, 647 bp, Homo sapiens
  misc_feature: GZ8MTXP01EOJPW.17.31.C09.1.454.CMB.2.raw
  modified_base (342)..(342): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtggctccagcacgtggagctgtcaccaatggtcattactccctactggttccaaacagaagcctggacccaacgcccccaaggacactgtatttanagataacaaacaaacaaacaacctcctcgacccctcgcccgttctcgacggcctcccgtcgggttggggacaacggctcgccccgttcgtaccccgtttcggggcgccgcgacgccgttaggaggggtagttgggacgggtcttaggtaaggttactttacctggtccttgtcctttccttcgttaagttgggtttggggttcgggttttcgggggttcgggtttccggggacggggttacggggaacccgtaagggtccgtcggtacccggttccgttaacggggtccaacgggtaacccccgg

SEQ ID NO: 374119 - DNA, 674 bp, Homo sapiens
  misc_feature: GZ8MTXP01A4PA4.17.31.C09.1.454.CMB.2.raw
  modified_base (269)..(269): a, c, t, g, unknown or other
  modified_base (298)..(298): a, c, t, g, unknown or other
  modified_base (340)..(340): a, c, t, g, unknown or other
  modified_base (367)..(367): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagccnggcccaacgcccccaggacactgatttangactaacaaacaacaacactccgtaccgaccctcgtccgtcncgacgtcctccgtcggtgggacagtcncgtcccgtacgtcccggttcgggtcgcgcgacgtccgtaggacggtagtggacggtcgtaggtacgttacttacgtcgttcgttcgtccttcctacgttaagtttcggggttgggggtttcggggtttcggggttcgggttaccggggaggggtaaccggtacgacggtccgtacggtacccgttacggtacggccgaaccgacccggttacgggtcccttcccggtccccggttcgttcccgttccgtttccgttccccggttcccccgtccccttacccgtccgttaccgtccgttccggtcggg

SEQ ID NO: 374120 - DNA, 554 bp, Homo sapiens
  misc_feature: GZ8MTXP01EFW7P.17.31.C09.1.454.CMB.2.raw
  modified_base (226)..(226): a, c, t, g, unknown or other
  modified_base (267)..(267): a, c, t, g, unknown or other
  modified_base (270)..(270): a, c, t, g, unknown or other
  modified_base (296)..(296): a, c, t, g, unknown or other
  modified_base (337)..(337): a, c, t, g, unknown or other
  modified_base (543)..(543): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattactccctatggttccaacagaanccngccaacgcccccaggacactgattanagataacaaacaacaaacactcctcgacccctgaccgttcncgagctccgtcggtggggacaaagctcgaccctcgtcccgtttcgggtcgcgcagccgtaggaggatggaggtcgtagtagttattacgtgtcttgcttctctatgttggggtgttcgggtgtcggcggaggacagctgtacccgtcgacggtcaacgtccgaggccttcgcccctggccttcttcctcgtccccaaccctcctcncgtccttcgcg

SEQ ID NO: 374121 - DNA, 567 bp, Homo sapiens
  misc_feature: GZ8MTXP01A9XB2.17.31.C09.1.454.CMB.2.raw
  modified_base (419)..(419): a, c, t, g, unknown or other
  modified_base (484)..(484): a, c, t, g, unknown or other
  modified_base (515)..(515): a, c, t, g, unknown or other
  modified_base (544)..(544): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaacgcctggacccaacgccccccaggaccactcgtatttatgaataacaaaacaacaaacactccctggacccctgcccggttctcacgctcctccggttgggggcaacgctcgaccctcgtaacccgtttcgggtcgacgccacgccgtgaggtntgaggcgtgagttattacgtgcttgcttcgtctagttcgtggggtgttcggggtgttcgggcggnggaccaagctgccgtcagtcaacgccagccncgaccccgtcgccgcttctccgttccccnccctcctcgttacgtcgttcgcg

SEQ ID NO: 374122 - DNA, 634 bp, Homo sapiens
  misc_feature: GZ8MTXP01A5B8B.17.31.C09.1.454.CMB.2.raw
  modified_base (304)..(304): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtccccaggagggacagtcactctcacctgtggctccagcactggagctgtcaccaatggtcattactccctactcggttaccaanagaacgcctcgggacccaacgcccccgaaggaccacgtgtatttagtacgaactaaacaaacaaaccaaacgaaccctacctccggacccctcggtccccgggttctcgacggtcctcccgtcggttcggggacaacgcgtcgacccgtcgtacccgtttcgggcgacgcacggtcctggaggggtacgtggtacgtcgtggtagttcttacgtgtcgttgccttctccgttaagtcggttgggtggtttcggggtcggttcgggcggggttacgggttacccgaaggtccgtcggacccggtcgttacgggtccgaacggtaaccccgg

SEQ ID NO: 374123 - DNA, 615 bp, Homo sapiens
  misc_feature: GZ8MTXP01BGQNT.17.31.C09.1.454.CMB.2.raw
  modified_base (339)..(339): a, c, t, g, unknown or other
  modified_base (411)..(411): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgccccccaggacactgatttatgatacaaacaacaaacactcctcggacccctgcccgttcncacggctccgtcgttggggcaaagctcgccctcgcccgtttcgggtcgcgcacgcctgggacgagtgacggngtgtagtagttacgtcgtcttcgtcttctctacgttagttggggttggttcgggttggttcgggtcgggtacgggaccggacgtacgtcgtccgtccgtacggtcgaacgcccgaccggccgttccgtccccgtccggttcccgttccttccgttccgttccccggtcccctcccttcccgttaccgtccgttaaccgtcccgg

SEQ ID NO: 374124 - DNA, 754 bp, Homo sapiens
  misc_feature: GZ8MTXP01BCEVJ.17.31.C09.1.454.CMB.2.raw
  modified_base (230)..(230): a, c, t, g, unknown or other
  modified_base (274)..(274): a, c, t, g, unknown or other
  modified_base (301)..(301): a, c, t, g, unknown or other
  modified_base (344)..(344): a, c, t, g, unknown or other
  modified_base (429)..(429): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtcgtccccagggagggacagtcactctcacctgtcggctccagcacgtgganctgtacacaatgtcattactccctatggttaccaacagaagccnggccaacgcccccagacactgtattangataacaaaacaacaaacactccgacgacccctgtccccgttntaccgagtcctaccgtccggttggggacaagcccgtacgccccgtacgtcccgtttcgggcgtccgctaacgccgtaggaggtangggacggtctaggtagttaacgtttacgtcggtccttcgcctttacctcccgtttaaggttacgggtttcgggggtttcggggtttccgggggttacggtttaccgggggaccgggtaaacggggaaccccgtaggtaccccggtacggtaccccggttacccgttaacgggccccgtaaccggaccccgttaacgggtccccgttccccgggtcccccccgtttaacgggttccccttacccgtttcccgttaaccccccggttccccctaaccccttttcccccggttaccgttaacccggtttcccgttaaccgggtcccgg

SEQ ID NO: 374125 - DNA, 737 bp, Homo sapiens
  misc_feature: GZ8MTXP01AUSPN.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtcccgaggagggacagtcactctcacctgtgctcagcactggagctgtcaccaatggtctattactcccctactcggttaccaaacagaacgccgtcggacccaaccggccccccgaagggacctacctaggtaactttatacgaacttaaacaaaaccaaaacaaaacctaaccctacccgtccggtaccccctcgtaccccgggttacctccgacggtcccgttccccgttcggggttacgggggaccaaacggtcctccggtaccccgtccggtaccccggtttcggggtcgccggacgacgccgtgggaacggggtagtgggtaacggtcgttagtaacggtttaactttacgtacgtcgttcgtaccttccgttccgttaaagtgggtttggggttcggttttcggggggtcggtttccgggggaccgggggttacggggttaacccgtaacgggtccgtaacggggttacccgtaccggtttacgggtcccgttaacccgggtaaccccggg

SEQ ID NO: 374126 - DNA, 704 bp, Homo sapiens
  misc_feature: GZ8MTXP01C8X8D.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtccccagggaggacagtcactctcacctgtcggctccagcactggagctgtcaccaatggtcattactccctacgtcggttaccaacgagaacgcctacggacccaaaccgccccccaagggacctactgtatttactagaactaacaaaacaaaccaaaccaacctccctcggaaccccctcggtacccccgggtttctaccgacggtcccgttaccccgttcgggttacgggggactaaacggccgttaccgcccgtttaccggtaccccgttttcgggcgccgcacggcccgttggacgggggagttaggacgggtccgttaggacgttacgtttacgtcgttcgttcggtccttccgttacccgttaaaggttcgggtttggggttcggggtttttcgggggtcggtttccgggggacgggttacgggaccgtaacggtcgtaacggtcccggtcgttacggtccgaaccggtaaccccgg

SEQ ID NO: 374127 - DNA, 622 bp, Homo sapiens
  misc_feature: GZ8MTXP01EDBQL.17.31.C09.1.454.CMB.2.raw
  modified_base (304)..(304): a, c, t, g, unknown or other
  modified_base (395)..(395): a, c, t, g, unknown or other
  modified_base (453)..(453): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtcgctccagcacgtggagctgtccacaatggtcattactccctaactcggttaccaanacgaacgcctacggccaacgcccccaggacactgatttatcgaatacaaacaaacaaacctacctacctcggacccctcggccccggttcncgtacggcctcccgtggtcgggggacaaagctacggcccttcggtacccgtttcgggngccgcacgccttaggagggtacgtggaacggtcgtagtaagtacgtttacgtcgtcttcggtcttcctcgttaattaggttgggtcggttttcggggtcgttcggggacgggttacgggaacctaaggtctccggtaacgtccgttacgggtaaccaacgtaaccccgg

SEQ ID NO: 374128 - DNA, 654 bp, Homo sapiens
  misc_feature: GZ8MTXP01EQUV5.17.31.C09.1.454.CMB.2.raw
  modified_base (272)..(272): a, c, t, g, unknown or other
  modified_base (332)..(332): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtcccgaggaggacagtcactctcactgtcgctcagcactggagctgtaccaancgtactacgttactaccttactaccgttacctaacgtaccgaaacgaccgtaacggcccncgaacccgaacccccgaccggaacgaacctacgtaagttaactttaacgtaagtaaactaaaaccaaaaccaaaacctaaaccgtaccctaccggtaccccgtacccgtacccggttcccgttcctacggacgtcccgtcccgttcggggtcgggaacgacgtcgtccgtccgtaccgttccggttcgggtcgccgacgccgtcgtaggagtagtaggacggtcgtaggtaagttaacgttacgtcgttcgtcgtcttccgttcgttacgttgggttgggttcgggttcgggttcgggttcgggtaacggggaacggtaacg

SEQ ID NO: 374129 - DNA, 807 bp, Homo sapiens
  misc_feature: GZ8MTXP01AFYXF.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaagccccccaggacactgatttactgataacaaaacaaacaaacacctcctacggacccctcgaccccggttctcgacggcctccccgtccggttcgggggacaaaggtcctcgtccccgttcgtccccgttttcggggcgcggccacggcccgttaggacgggtattgggacgggtccttagggtacgttagtttaaccgtggtccctttgggccctttccgttaaccccgttaggtttaaggggtttcggggggggtttcggggttttcccgggggggtttggggtttttaccccggggggacggggggttaaaccgggggaaccccgtaaggggtacccgtttacggtacccccgggtttaccgttaacgggggttcccaacggggaacccccgaacgggtcccgttcccgggtcccccccgttccgggggttacccttccccgttccccgtttccccgggtttaccccccctcccccgtttcccccgggttccctttaacccggttcccgtttaaccggggtccccgg

SEQ ID NO: 374130 - DNA, 618 bp, Homo sapiens
  misc_feature: GZ8MTXP01BTHIX.17.31.C09.1.454.CMB.2.raw
  modified_base (299)..(299): a, c, t, g, unknown or other
  modified_base (337)..(337): a, c, t, g, unknown or other
  modified_base (567)..(567): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaacgcccccaggacactgatttangatacaaacaacaaacactcctcgacccctgcccgtcncagctccgtcgtggggcaaagctcgccctgtcccgtttcgggtcgcgcacgccgtggacggatggacggtcgtagtaggttattacgtgtcttcgcttctccgtagttaggttgggggttcggtttcggggttgttcggggacggacgggaccgaaggtccgttacggtacccgtcgttaacggtccaacggtccccgaagggtcccttccgtcccccgttcggttaccnccgttccgtccgttccccgcccttccctccgttacgtccgttaacgtccgg

SEQ ID NO: 374131 - DNA, 615 bp, Homo sapiens
  misc_feature: GZ8MTXP01AKL40.17.31.C09.1.454.CMB.2.raw
  modified_base (270)..(270): a, c, t, g, unknown or other
  modified_base (301)..(301): a, c, t, g, unknown or other
  modified_base (320)..(320): a, c, t, g, unknown or other
  modified_base (344)..(344): a, c, t, g, unknown or other
tcagcgtagactagcacgaccggtgctcgatttagacgtctcatcaaggaaggaaggggaccaggggtcccttccaatatcagcaccatggcctggactcctctctttctgttactcctcacttgctgcccagggtccaattcccaggctgtggtgactcaggagccctcactgactgtgtccccaggaggacagtcactctcacctgtcggctccagcactggagctgtcaccatggtcattactccctatggttccaacagaacgccnggaccaacgcccccgaggacactgtatttanagataacaaacaacaaacnctcctcggacccctcgtcccgttntcgacggcctccgtcggtgggggacaagcctcgccctcgtcccgtttcgggcaccggtcacgcgtagggacgtagtggagtcgtagtacgttattacgtgtctagtccttactctagttcggtgggggttcggttcggggtcgtcgggcggacgggacaggcgttacgcccgtcgtacgtcgaaccgtcccgaaggcccttcccgtccccgtcggttcccttccgttcctcccgttacccctcccttacctccgttacgtccgttcgtccg

SEQ ID NO: 374132 - DNA, 686 bp, Homo sapiens
  misc_feature: GZ8MTXP01AJWWB.17.31.C09.1.454.CMB.2.raw
  modified_base (597)..(597): a, c, t, g, unknown or other
tcagcgtagactagcacgaccggtgctcgatttagacgtctcatcaaggaaggaaggggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaggcccggggatctctgagatctcctggtaaggttctggatacgtaggtttcagctactggatcgacgtgggcgccgccgaaggaacggtacccgggtaaaggccgtagggacggtgggagtgggggagtattggactcccgagttcgactctacatactacaactacccgaccgtacccgttccgttacccgaacggaccccacgttccaaccctatcctcgacgctacgaactacgtcctagtactacgtacctcgtcccttcgacgcgtacggtcggaccgcgacggccggtggggaccggtcccgtacccgggaaccacccggtacctaagttaacgttacgttcgtaggtccggaccggttaaccgggttcgggtttacncccgggccgtacgtaacggttcttaacgttaccttaaccgttacctaacggtaccggtcggttaacggtccgttcggggtaacccgggg

SEQ ID NO: 374133 - DNA, 888 bp, Homo sapiens
  misc_feature: GZ8MTXP01AWY16.17.31.C09.1.454.CMB.2.raw
  modified_base (271)..(271): a, c, t, g, unknown or other
  modified_base (299)..(299): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttcccaacagaagccnggccaacgcccccaggacactgatttangataacaaaacaaacaaacactcctacggaccccctgccccgggttctccgacggcctccccgtcggttacgggggacaaacggtcctcgtaccccgttcgtaaccccgtttcgggggtacgccggtccacgggtccccgttagggaacgggtaagttgggaacgggtccgttagggtaaccgtttaagtttaacccgttgggttcccttttacgggtacccgtttccttaaccccgtttaaggtttaacggggtttcgggggggggtttcggggttttaccggggggttttacggggttttcccggggggaaccgggggttaaacgggggtaaacccccggaaaaggggttcccggttaccggggttaacccccggttaccccgggtttaaaccgggggttcccgtaaacccggggacccccggttaaaacgggggtccccgtttccccgggtaacccccccccggtttcgggggtttaccccgttaacccgtttccccgtttaaccccgggtttccccccccggtaaccccccttttccccgttacccccgtttaacggggtttccccttaacccggttccccgggg

SEQ ID NO: 374134 - DNA, 792 bp, Homo sapiens
  misc_feature: GZ8MTXP01CKOYX.17.31.C09.1.454.CMB.2.raw
  modified_base (370)..(370): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgcccctcactgactgtcgtccccgaggaggacagtcactctcacctgtcggctccagcacgtggagctgtaccactaagtcggtactactttactcccctacgttcggttaccaaacgaggaaccgccgtcggacccaaccgcccccgaggtacactagtaactttanacgtaaactaaacaaaacaaaaccaaaccctaaccgttaccccgtccggtaacccccttccgggtcccccggtttacgtaccgaccgggttaccccgtccccggttcggggttacgggggaacctaaaccgggtccgttacccggtccccgttaccgggtttacccccggttttcgggggaccgtcccgggaccgtaaccgggtcccgttagggaacgggggtacgtagggtacgggtccgttacggtagtttaaacgttccggttcggtccttcggtaccctttccggttccgttaaggtttcgggtttgggggttcggggtttcgggggttgggttccgggggaacggggttacggaaccgtaagggtccgttaaccggtaccggttaccggttacgggaacccgttaacggaaccccgg

SEQ ID NO: 374135 - DNA, 657 bp, Homo sapiens
  misc_feature: GZ8MTXP01D1YJ6.17.31.C09.1.454.CMB.2.raw
  modified_base (273)..(273): a, c, t, g, unknown or other
  modified_base (301)..(301): a, c, t, g, unknown or other
  modified_base (428)..(428): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccaggtccaattcccaggctgtggtgactcaggagccctcactgactgtcgtccccaggagggacagtcactctcacctgtggctccagcactggagctgtacaccaatggtcattactccctatggttaccaacagaacgccnggaccaacgcccccaggacactgattanagaataacaaaacaaacaaaacactacctacgacccctcgtcccggttctaccgacggtcctcccgtccggtacggggacaaacgctcgacccgtcgtcccgttcgggtcgccgcacgcgtgaggtntgaggctaggattacttacgtcgtcgttcgcttctccgttagttacggttgggggtttcggtttcggggttggttccggggacggtaacgggacctaaggtccgtacggtacccgttaccgtaacggtcgaaccgcccgaaacggtcccgttacccgcccccgttcgttaccgttccttcccgttaaccgtcccctaacccttcctaccttacgtccgttaacgtccgg

SEQ ID NO: 374136 - DNA, 630 bp, Homo sapiens
  misc_feature: GZ8MTXP01BAT8A.17.31.C09.1.454.CMB.2.raw
  modified_base (170)..(170): a, c, t, g, unknown or other
  modified_base (226)..(226): a, c, t, g, unknown or other
  modified_base (271)..(271): a, c, t, g, unknown or other
  modified_base (297)..(297): a, c, t, g, unknown or other
  modified_base (550)..(550): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctnactgactgtgtccccaggagggacagtcactctcacctgtggctccagcactgganctgtcaccaatgtctattactccctatggttaccaacagaagccngccaacgccccaggctactgatttangataacaaacaacaaacactcctcgacccctgcccgttactcagtcctccgtcggttcgggggcaagctcgcccgttcgcccgtttcgggcgcgcacgtccgtaggacggagttcgggagtcgtagtagttagtttaccgtgtcttcgcttcttccgttatgggttggggttggttcggggttggtccgggtacgggacggtacgaacggtcgtcggacccgttcggtacgtcgtaaccgaccgacggtcccncccgtccccgtcggttcccacgttcccttaacccggttccccgtccccttccctaccgttaccgttccgaacgtcccggg

SEQ ID NO: 374137 - DNA, 674 bp, Homo sapiens
  misc_feature: GZ8MTXP01EST6T.17.31.C09.1.454.CMB.2.raw
  modified_base (420)..(420): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcgaggacgcccctcactgactgtcgtccccgaggaggacagtcactctcacctgtcggcctccagcacgtggacgctgtcaccaagtcggtactattactccctactcggtaccaacacgaacgccgtcggacccaaccgcccccgaaggaccactagtatttatacgaataaacaaaacaaacaaaccaaccctacccgcggtacccctcgggtacccgttcncgacggtcctcccgtcggtcggggacaacggtctccgcccgtcggtacccgtttgggcgtcgcgtacggcgtacggaggggtagtcgggtaggcttaggtacgttactttaacgtgtaccttcgtccttccgttacgtaaggtttcgggttcggggttcgggtttacggggttcgggttccggggacggggttacgggaccgtaacggccgttaaccggacccgttcggttacggtcccgaaccggtaaccccg

SEQ ID NO: 374138 - DNA, 680 bp, Homo sapiens
  misc_feature: GZ8MTXP01AEG2M.17.31.C09.1.454.CMB.2.raw
  modified_base (263)..(263): a, c, t, g, unknown or other
  modified_base (516)..(516): a, c, t, g, unknown or other
  modified_base (666)..(666): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctcgcccagggtccaattcccaggctgtggtgactcaggacgccctcactgactgtcgtccccagggaggacagtcactctcacctgtcgctccagcacgnggagctgtacaccatcggtctattactccctacgtcggttaccaacgacgaacgccgtacggacccaacgccccccaggaccactcgtatttacgacgtaactaaacaaactaaaccaaacccaacctacccgtcccgaccccgtccggtacccgtttccacgtacggtccctcccgtacgggttacgggggacctaacgccgtccgtcccgtacggtacccgttcgggtccgcgcacggccgtggaacgggngtggacgtcgtagtacggttacttacgtcgtcttcgtccttacgttccgtaaggttcgtttcggggttgggttccggggttcgggttccggggacgggacgggacccgtaacggtccggtccggtaacccgttcgttaccggggtaaccncccgggtaacccgg

SEQ ID NO: 374139 - DNA, 634 bp, Homo sapiens
  misc_feature: GZ8MTXP01AX06A.17.31.C09.1.454.CMB.2.raw
  modified_base (301)..(301): a, c, t, g, unknown or other
  modified_base (487)..(487): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtgctcagcagtggagctgtcaccaatggtcattactccctactggttacccaanacgaagcctaggccaacgcccccaggaccactgatttatacgactacaaaacaacaaactaacctcctcggacccctcgccccggttacctcgacggtcctcccgtacgggttggggaaccaaaggtcctacgcccttacggtacccgtttcgggtcgccgtccgaaggtccttggaagggggttntacggtacgtacgttagtacgttacgttacgtcgtcgttcgcttccgttcgtaagttcgggtttgggttcgggttcgggttcgggtacggggacggacgggaccgtaaggccgtcggtacccgtacggttacgggtcgccggtcccg

SEQ ID NO: 374140 - DNA, 639 bp, Homo sapiens
  misc_feature: GZ8MTXP01AK0OE.17.31.C09.1.454.CMB.2.raw
  modified_base (271)..(271): a, c, t, g, unknown or other
  modified_base (299)..(299): a, c, t, g, unknown or other
  modified_base (338)..(338): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccaggtccaattcccaggctgtggtgactcaggagccctcactgactgtgtccccaggagggacagtcactctcacctgtcggctcagcacgtggagctgtccaccaatgtctattactccctatggttaccaacagagccncggccaacgccccaggacactgatttanagataacaaacaacaacactcctcgaccctgcccgttcncgacgcctccgtccggtcggggacaacgcctacgccctcggtcccgttgggtcgacggcacggtccgtaggaggtacgtggaaggtcgtaggtagttacttacgtgtccgttgtccttacgttaccttagttcgggttggggggtttcggtttcgggggttcgggttcggggaacggggtacggaccgtaacggtcgtacgtacccgtcgtaacgtcgaacgaccgcggtccttcccggtcccgtccggttccttccttccgtccctcccctcccgttcctccgttacgtccgttcgtcgg

SEQ ID NO: 374141 - DNA, 649 bp, Homo sapiens
  misc_feature: GZ8MTXP01B0J3X.17.31.C09.1.454.CMB.2.raw
  modified_base (229)..(229): a, c, t, g, unknown or other
  modified_base (258)..(258): a, c, t, g, unknown or other
  modified_base (263)..(263): a, c, t, g, unknown or other
  modified_base (265)..(265): a, c, t, g, unknown or other
  modified_base (289)..(289): a, c, t, g, unknown or other
  modified_base (335)..(335): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggacgccctcactgactgtcgtccccgaggagggacagtcactctcacctgtgctccagcacgtgganctgtcacaatgtcattctcctatgtcaanagacncngaccacgcccagacactgtattanagaataacaaacaacaaacactccgtacgacccctcgtcccgttcncgacggtcctccgtccgggtacggggacaacgcctacgtcccctcgtccccgttgggtcgccgcgacgtccgtagggaggtacgtggacggtacgtagtaacgttagttacgtgttcttcgtcttccttcgttagttgggttgggggttcgggtttcggggttcggtcggggtacgggacggaccgtagtccgtacggtacccgtacgttacggccgaacgacccgacggtcccgttccggtccccgtcggttcccttccttcccgttcccggttccccctcccgttccgtccttacgtaaccgttcggtccgg

SEQ ID NO: 374142 - DNA, 585 bp, Homo sapiens
  misc_feature: GZ8MTXP01A5PMO.17.31.C09.1.454.CMB.2.raw
  modified_base (202)..(202): a, c, t, g, unknown or other
  modified_base (246)..(246): a, c, t, g, unknown or other
  modified_base (298)..(298): a, c, t, g, unknown or other
  modified_base (479)..(479): a, c, t, g, unknown or other
  modified_base (556)..(556): a, c, t, g, unknown or other
tcagcgtagactagcacgaccggtgctcgatttagacgtctcatcaaggaaggaaggggagataaagagccatcagaatccagccccagctctggcaccaggggtcccttccatatcagcaccatggcctggactcctctctttctgttcctcctcacttgctgcccagggtccaattcccaggctgtggtgactcaggacnccctcactgactgtcgtcccaggaggacagtcactctcacctgnggctcagcacgtgagctgtcaccaatgtcattactcctactcggttaccaanacgaacgcctacggccaacgcccccgaaggacactgtatttacagtaactaacaaaacaacaaactacctacccgtcgacccctcgcccggttctcgacggtcctacccgtcggttcgggggacaaacgcgtacgcccgtcgtaccccggtttcggcgccgcgacgccgttggaacggggntaggacgtcgtagtagttatctgtctgctctctaagtgttcggtggttacgggtggttcggcggcgggacaaggtcncggtaccgtcgttacgtccgcgtaacccg

SEQ ID NO: 374143 - DNA, 697 bp, Homo sapiens
  misc_feature: GZ8MTXP01CTRHH.17.31.C09.1.454.CMB.2.raw
  modified_base (364)..(364): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcgaggacgccctcactgactgtcgtccccgaggacggacagtcactctcaccgtgtcggctccagcacgtggacgctgtccactaagtcggtctattactcccctactcggttaccaacagaacgccgtacggacccaaccggcccccaggacctacgtagtatttanacgactaacaaacaaaccaaacaccctacccgtccggacccctcgggtccccgttcaccgtacggtccctccccgtgggttacgggggaccaacggtccgtccggtccccgtacggttaccccggttttcggggcgtaccgccgtacggtccgtaggacgggggtagtggtacggtacgtaggtagttacgttcgtagtccgttcgaccttccgttacgttaaggttaggttcgggggttttcgggttcgggggttcgggtttcggggcgggttaccggggttacctaaggccgttcggacccggttccgttacggtaaccgccgtaacccgg

SEQ ID NO: 374144 - DNA, 578 bp, Homo sapiens
  misc_feature: GZ8MTXP01EIC58.17.31.C09.1.454.CMB.2.raw
  modified_base (268)..(268): a, c, t, g, unknown or other
  modified_base (295)..(295): a, c, t, g, unknown or other
  modified_base (340)..(340): a, c, t, g, unknown or other
  modified_base (489)..(489): a, c, t, g, unknown or other
  modified_base (541)..(541): a, c, t, g, unknown or other
  modified_base (573)..(573): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctccagcactggagctgtcaccaatggtcattactccctatgttccaacagaagccnggccaacgcccccagacactagattanagataacaaacaaacaaaacactacctcgacccctgcccggttcncacggcctcccgtcggttcgggggacaaggctcgccctcgtcccgtttcgggtcgccgcgacgcctaggacggtagtggaggcgtagtagttattacgtgtctttcgcttctcttagtaggttgggggtggttcggggtgttaccgggnggacggacaagctcgtaccgtcagtcaacgccgagccttccgccctcgttcncttcctcgttccccaaccctcctacttcgtcncgtcg

SEQ ID NO: 374145 - DNA, 792 bp, Homo sapiens
  misc_feature: GZ8MTXP01DE72S.17.31.C09.1.454.CMB.2.raw
  modified_base (269)..(269): a, c, t, g, unknown or other
  modified_base (273)..(273): a, c, t, g, unknown or other
  modified_base (276)..(276): a, c, t, g, unknown or other
  modified_base (304)..(304): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccagggagggacagtcactctcacctgtggcctccagcactggagctgtacaccaatggtactattactccctactggtacccaanaganccnggaccaacgccccaggacactgtattangaataacaaacaaaccaaactacctaccgtacggtaaccccctcggtccccggttctcgacggtccgttcccggtccgggttacggggggactaaacggtcctccggtaccccgttacggttccccggttttcggggcggtaccggtaccgcggtcccgtagggacgggtaacgtcgggaacggtcgttagtaaggtttacttacgtcgttcgttacgtccttcttaccgttagtacgggtttcgggggttcggggtttcggggttcgggttaccggggcggggtaaaccgggtaccgtaacgggtacccgttccggtaacccggttccggtaacggtcccgaacccgggtaacccgttaacgggtcccgttccccggttccccccgggtaacgttccccgttaacccgtttcccggttcccccggtttaccccctaacccccggtttacccttaccggttacccgttaacccggttcggtccccggg

SEQ ID NO: 374146 - DNA, 659 bp, Homo sapiens
  misc_feature: GZ8MTXP01E0O8X.17.31.C09.1.454.CMB.2.raw
  modified_base (272)..(272): a, c, t, g, unknown or other
  modified_base (299)..(299): a, c, t, g, unknown or other
  modified_base (345)..(345): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccgaggagggacagtcactctcacctgtggctcagcacgtggagctgtcacaatgtactattactccctatggtaccaagagaacgccnggaccaacgccccagacactgtattangaataacaaacaaacaacactccgtacgacccctcggtcccgttcncgacgtcctccgtcggtacggggacaacgcgtcgccctcgtcccgttcgggcgcgcgagtcgtgacggtagtgaggtctagtaagttattacgtgttcgttcgtccttcttacgttagttacgggttgggggtttcggggtttcggggtcggttacgggggacggtaacgggaaccgaggccgttcggtacccgtcgtacgggtccaacggacccgaacgggtcccttcccggtacccccgttcggcccttaccgttcccgtttccccgtccccctaacccgttacccctcgttaccgtccgttaaccggtcgg

SEQ ID NO: 374147 - DNA, 707 bp, Homo sapiens
  misc_feature: GZ8MTXP01CUUW3.17.31.C09.1.454.CMB.2.raw
  modified_base (319)..(319): a, c, t, g, unknown or other
  modified_base (700)..(700): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtcggctcagcactggagctgtcaaccaatggtctattactcccttactcggttaccaaacgagaacgccgtggacccaaccggcccccaaggactacctgtaagtttanagaactaaacaaaacaaaccaaaacctaacctccgtaccggtaccccttcggaccccggtttctaccgacgtccctacccggttccggttacgggggaactaacggtcctccgtaaccccgttcgttcccggttcgggtcgcgacgtcgcgtaggaggagttggagtcgtagtagttacgttagtcgttctgtccttctaccgttaagttggggtggggttcgggtttcggggtcgggttcggggaacgggtacgggtaaccgacggtacgcgtacccggtacgtcggtaaccgaaccgacccgacggttccgcccggtacccctcggttacccgttccttccgttcccgtacccctaacccttccgtacttccggtaacncgtccgg

SEQ ID NO: 374148 - DNA, 742 bp, Homo sapiens
  misc_feature: GZ8MTXP01AGVN8.17.31.C09.1.454.CMB.2.raw
  modified_base (281)..(281): a, c, t, g, unknown or other
  modified_base (311)..(311): a, c, t, g, unknown or other
  modified_base (451)..(451): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtcgtccccgaggagggacagtcactctcacctgtggctccgagcacgtggagctgtcaccaatggtctattactccccttactcggttaccaacagaagcccnggacccaacgcccccgagacactgtattangaataaccaaaacaaaccaaactacctaccgtaccggtacccctcggtccccggttactccgacggtcccgtccccgttacgggttacgggggacaaaggtcccgtaccggccccttacggttccccggtttcggggtcncccggccgtacgccgttagacgggacgttagggacggtcgtaggtaagttacttacgtcgtacgttcgaccttcttccgtaagtttgggttcgggggttcggtttccgggggttggttacccgggggtaggggaccggtaaccgtaacggtacccggtcgtacccggttaccgtacgggtccgaaccgtaccccggttaaggtccccttcccgggtccccttcgggttcccttccgttcccttcccggttccccctccgttcccctaccgttccgtaacccgttcggtccg

SEQ ID NO: 374149 - DNA, 671 bp, Homo sapiens
  misc_feature: GZ8MTXP01D4A5L.17.31.C09.1.454.CMB.2.raw
  modified_base (271)..(271): a, c, t, g, unknown or other
  modified_base (302)..(302): a, c, t, g, unknown or other
  modified_base (406)..(406): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccaggtccaattcccaggctgtggtgactcaggacgcctcactgactgtgtccccgaggagggacagtcactctcacctgtcggctcagcactggagctgtcacatgtctattactccctacgtgtaccaagacgaacgccncggaccaaccgccccgaagacactgatttanagaataacaaaacaacaaacgtctccgtacgacccctggcccgtctcgacgtcctaccgtcggttcgggacaacgcgtccgaacccttcgtcccgttcgggtcncggtcacggtccgtggagtagtgagtctagtacgttacgttactgtcttcgaccttcgtacgttaggttcggttgggggttcggtttcgggggttacgttccgggggacggacggggtacacggtacgtaccggtacccgtacggttacgccgtaaccgcccggttaacggtccccgttccgacccccggttcgttaccccgttccgttaccctttcccgtccccttaaccgttccctccgttaccgttccgttaacgtcccggg

SEQ ID NO: 374150 - DNA, 575 bp, Homo sapiens
  misc_feature: GZ8MTXP01DYR7T.17.31.C09.1.454.CMB.2.raw
  modified_base (269)..(269): a, c, t, g, unknown or other
  modified_base (384)..(384): a, c, t, g, unknown or other
  modified_base (452)..(452): a, c, t, g, unknown or other
  modified_base (531)..(531): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggaggggacagtcactctcacctgtggctccagcactggagctgtcaccaatgtcattatccctactggttcaacagaagccngccaagcccccaggacactgattatgatacaaaacaacaaaacactcctcgacccctagcccggttactcaggctcctccgtcgggggcaaagctgccctgaacccgtttcgggngtccgcacgcctggacggatgaggctgagtacgtatgcttgctctcagttagtgggggtagttcgggnggttgggacggagggtaccaagcttaggccgtacctaggtccaagtccccgaaaggtccgttcgcccccgtcggttccncttccgttcgtccccgcccctctcccttacgtcgttaaccgtcg

SEQ ID NO: 374151 - DNA, 669 bp, Homo sapiens
  misc_feature: GZ8MTXP02IOUNF.17.31.C09.1.454.CMB.2.raw
  modified_base (272)..(272): a, c, t, g, unknown or other
  modified_base (464)..(464): a, c, t, g, unknown or other
  modified_base (477)..(477): a, c, t, g, unknown or other
  modified_base (648)..(648): a, c, t, g, unknown or other
  modified_base (667)..(667): a, c, t, g, unknown or other
tcagcgtagactagcacgaccggtgctcgatttagacgtctcatcaaggaaggaaggggaccaggggtcccttccaatatcagcaccatggcctggactcctctcttctgttcctcctcacttgctgcccagggtccaattcccaggctgtggtgactcaggagccctcactgactgtgtccccaggagggacagtcactctcacctgtggctccagcactggagcctgtaccaacagtcgtactattacctccctacgttcggtaccaaanagaacgcgtcggaccaaccgcccccgaggaccactagtaatttagtagaactaaaacaaaaccaaaaccaaaacctaccgttccggacccggtaccccctccggtcccgtttcctacgacggtcccttccccgtttcggggtcggggaaccaacgtcgtccgtcccgtcgtccccgggtttgggcgccgacnccgtcagggtagngtaggcgtgtagagtttaacgtcgtgtcttcgccttacctacttaagttgggtttggttcggggtttcgggtcgggttcgggaacgggtacgggaaacacggtgtaccggtacccttcggtacgtcgaccgaccgacggtctccgccccgttcgcctctcgtccgtccccncccttctacgtctcgtacncg

SEQ ID NO: 374152 - DNA, 539 bp, Homo sapiens
  misc_feature: GZ8MTXP02JWZBN.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggtctcaggctcctccgttgggggcaaagctgccctgccctttcgggtgcgcagcctgaggatgaggctgagtattactgcttgctctcctatagtggtgttcgggtgttcgggcggtagggaccaaggctgaccgtcctaggtcagcccaaggctcgccccctcggccactctcgttccccaccctcctccctacgtcctacgtccg

SEQ ID NO: 374153 - DNA, 558 bp, Homo sapiens
  misc_feature: GZ8MTXP02IC9JT.17.31.C09.1.454.CMB.2.raw
  modified_base (336)..(336): a, c, t, g, unknown or other
  modified_base (454)..(454): a, c, t, g, unknown or other
  modified_base (484)..(484): a, c, t, g, unknown or other
  modified_base (513)..(513): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaacgcccccaggacactgatttangaataacaaacaacaaaacactaccctggaaccccctgcccccggtttactccgacgggtccttccccgtcggttgggggacaaagcctcgcccctgtacccgttttcggggcgccgnacgcctgaggatgaggtctagagtattacngcttgctctctatgttggtgttcggggtnttacgggcgtagggaccaagctacgcgtccgtaggtcacgacccg

SEQ ID NO: 374154 - DNA, 536 bp, Homo sapiens
  misc_feature: GZ8MTXP02JJE53.17.31.C09.1.454.CMB.2.raw
  modified_base (297)..(297): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaaacactcctggacccctgcccggttctcaggctcctcgttggggcaaagctgccctgccctttcgggtgcgcagcctgaggatgaggctgagtattactgcttgctctcctatagtggtgttcggggtgttcgggcggtagggaccaggctgaccgtctaggtcacgcccaggcctcgccccctcggtccactcgtcgtccctaccctcctcctacgtctacgcg

SEQ ID NO: 374155 - DNA, 539 bp, Homo sapiens
  misc_feature: GZ8MTXP02HXP7R.17.31.C09.1.454.CMB.2.raw
  modified_base (298)..(298): a, c, t, g, unknown or other
  modified_base (337)..(337): a, c, t, g, unknown or other
  modified_base (377)..(377): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtcccccaggagggacagtcactctcacctgtggctccagcactggagctgtcaccaatggtcattatccctactggttccaacagaagcctggccaagcccccaggacactgatttangatacaaacaacaaacactcctggacccctgcccgttcncaggctcctcgtggggcaaagctgccctgcccgtttcggncgcagcctgagatgagctgatattactgtctgctctcctattagtggtgttcgggtgttcgggcggagggccaagctgaccgtcgtaggtcacgcccgaaggcctcggccccctcggtccacgtcgtcgttccccgcccttcccgtcctacgtcttacgccg

SEQ ID NO: 374156 - DNA, 547 bp, Homo sapiens
  misc_feature: GZ8MTXP02HQLY8.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctcctccgttggggcaaagctgcccctgccctttcgggtgcgcagcctgacggatgaggctgagtattactgcttgctctcctatagtggtgtttcgggtgttcgggcggtagggaccgaagcgtgaccgtcgtaggtcacgcccgaaggctcgccccctcggtccacgtctcgttccccacccttccctcctacgtccttacgcc

SEQ ID NO: 374157 - DNA, 532 bp, Homo sapiens
  misc_feature: GZ8MTXP02HXENE.17.31.C09.1.454.CMB.2.raw
  modified_base (297)..(297): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaaacactcctggacccctgcccggttctcaggctccctcgttggggcaaagctgccctgccctttgggtgcgcagccctgacggatgaggctgagtattactgcttgctctcctatagtggtgttcgggtgttcgggcggtagggaccaagctgaccgtctaggtcacgccaaggctcgcccctcggtcactctcgtcccacctcctcctacgtctacgtcg

SEQ ID NO: 374158 - DNA, 533 bp, Homo sapiens
  misc_feature: GZ8MTXP02GB5HV.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttccccctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttcggggcaaagctgccctgacccttcgggtgcgcagcctgaggatgaggctgagtattactgcttgctctcctatagtggtgttcgggtgttcggcggagggaccaagctgaccgtctaggtcacgcccaaggctcgcccctcggtccactctcgtcccgccctcctcctacgctacgctagg

SEQ ID NO: 374159 - DNA, 606 bp, Homo sapiens
  misc_feature: GZ8MTXP02JJ6WF.17.31.C09.1.454.CMB.2.raw
  modified_base (341)..(341): a, c, t, g, unknown or other
  modified_base (388)..(388): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttcccaacagaagcctggccaacgcccccaggacactgatttatgatacaaacaacaaacactcctcggacccctgcccggttcncaggcctcctccggtcggggcaaagctcgccctgtcccgtttcgggncgcagccgtgaggactgaggctgagttattacgtgtcttgcttctaccttagtcggttgggttggtttcgggggtcggtttcggggacgggaacgggacccgaaggtcgttacggacccgttacgtacggtacgaccggcccgaaaggccctccgcccccgttccggtcctaccttccgtccgttccccgtcccttccctcctacggtcctacgtccg

SEQ ID NO: 374160 - DNA, 522 bp, Homo sapiens
  misc_feature: GZ8MTXP02FHCJ0.17.31.C09.1.454.CMB.2.raw
  modified_base (335)..(335): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctcttctgttcctcctcacttgctgcccagggtccaattcccaggctgtggtgactcagagccctcactgactgtgtccccaggagggacagtcactctcacctgtggctcccagcactggagctgtcaccaatggtcattatcccctactggttccaacagaagcctggccaagccccccaggacactgatttangatacaaacaacaaacactcctgaccccctgcccgttctcagctccctcgttgggggcaaagctgccctgacccttcgggtgcgcagcctgaggatgaggctgagtattactgcttgctctcctatagtggtgttcggggtgttcggcggagggacccaagcgtacgaccgtcgtaggccacgaccg

SEQ ID NO: 374161 - DNA, 546 bp, Homo sapiens
  misc_feature: GZ8MTXP02FVFI6.17.31.C09.1.454.CMB.2.raw
  modified_base (380)..(380): a, c, t, g, unknown or other
  modified_base (411)..(411): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaaacactcctggacccctgcccggttctcaggctccctccgttggggcaaagctgccctgcccttcgggngcgcagcctgacgatgaggctgagtattacngtcttgctctctatagtggttgtcgggtgttcggcggtaggaccgaagctgaccgtcctagggtcacgcccgaaaggcctacgcccccgtcggtccacgtctcgttccccaccctccctcctacgtcctacgtcg

SEQ ID NO: 374162 - DNA, 549 bp, Homo sapiens
  misc_feature: GZ8MTXP02GBLJ0.17.31.C09.1.454.CMB.2.raw
  modified_base (339)..(339): a, c, t, g, unknown or other
  modified_base (397)..(397): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactcccctactggttaccaacagaacgcctggccaacgcccccaggacactgatttangatacaaaacaacaaacactcctgacccctgcccgtctcagctcctcgtgggcaagcncgccctcgacccgttcggtcgcgcacgctgacggagtgaggcgtgagtatacgtgtcttgctctctataggttggttcggttcggggttcggttcgggcgggtacggggacgaacggtcgtacgtaccggtccgtaacggtcgacgacccgg

SEQ ID NO: 374163 - DNA, 524 bp, Homo sapiens
  misc_feature: GZ8MTXP02IOQ7O.17.31.C09.1.454.CMB.2.raw
  modified_base (415)..(415): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcccctactggttccaacagaagcctggccaagcccccaggacactgatttatgatacaaacaacaaacactcctcggaccctgcccgttctcagctccctcgtggggcaagctgccctgacccgtttcgggngcgcagcctgaggactgaggctagagtattactgcttgctctcctatagtggtgttcgggtgttcggcggtaggaccgaagcgtacgaccgtcgtacggtcacgacccg

SEQ ID NO: 374164 - DNA, 546 bp, Homo sapiens
  misc_feature: GZ8MTXP02HQ4VQ.17.31.C09.1.454.CMB.2.raw
  modified_base (298)..(298): a, c, t, g, unknown or other
  modified_base (377)..(377): a, c, t, g, unknown or other
  modified_base (508)..(508): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtcccccaggagggacagtcactctcacctgtggctccagcactggagctgtcaccaatggtcattatccctactggttccaacagaagcctggccaagcccccaggacactgatttangatacaaacaacaaacactcctggacccctgcccgttctcaggctccctcgtggggcaaagctgccctgccctttgggncgcagcctgagatgaggctgagtattactgtcttgctactcctattacgtggttggtttcgggtgttcgggcggagggaccaagctggaccgtcgtacggtcacgcccgaaggcctcgcccctcggtaccnctctcgttccccgccctccctacctacgtccttacgcg

SEQ ID NO: 374165 - DNA, 537 bp, Homo sapiens
  misc_feature: GZ8MTXP02FZDBM.17.31.C09.1.454.CMB.2.raw
  modified_base (264)..(264): a, c, t, g, unknown or other
  modified_base (342)..(342): a, c, t, g, unknown or other
  modified_base (386)..(386): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccagggagggacagtcactctcacctgtggctccagcactgganctgtcaccaatggtcattactccctactcggttccaaacagaacgcctggacccaacgcccccaggacactgatttangataacaaaacaacaaacactacctcggacccctgcccggttcncacggctcccgtcgttcggggacaaagctcgccctcgacccgttcgggtcgcgcacgcctgacggatgagctagagttatactgtctgctctctatggtgtgttcggtgttcggcggaggacaagcgtacgaccgtcgtacgcacgacccg

SEQ ID NO: 374166 - DNA, 609 bp, Homo sapiens
  misc_feature: GZ8MTXP02IUNN7.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttcccaacagaacgcctggccaacgcccccaggacactgatttatcgatacaaacaacaaacacctacctcggacccctcgcccggttactccaggcctccctcggttcgggacaaagctcgccctgtacccccgtttgggtcgccgcgacgcccgtaggtaggagttggacgggcgtaggagttaacgttacgtcggtctttcggtcttcgtcccgttagtaggttcgggttggtttccggggtgggtttccgggacggggtacgggaccgaaggtccgtcggtacccggtacgtacggttccgaacgtccccgg

SEQ ID NO: 374167 - DNA, 653 bp, Homo sapiens
  misc_feature: GZ8MTXP02JQ2XL.17.31.C09.1.454.CMB.2.raw
  modified_base (240)..(240): a, c, t, g, unknown or other
  modified_base (454)..(454): a, c, t, g, unknown or other
  modified_base (461)..(461): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagcctgcacagtcgtntattactcctacgtcgtaccaacgagacgccgtggaccacccgccccgagacacgtgttatttagagactaaaccaaaaccaaacaaactacctccgaccggtacccctcggtcccggttctacgacgcccttccgtcggggttcggggaactaacgcgtcccgtccgtaccgttccccggtttgggcgccgacgcggtccgtagggagtaggnggacggngtagtagttactcgtcgtcttcgtcttaccttacttaggttggttgggttcgggtttgggtcgggttcgggacgggacggacgtacgtcgtcggtaccgtcgtacgcgaccggacgacggtccgtcccgtccccgtacgtcctaccgttccgtccccgtccccgtacccttcctacgtaccgtcgtacgtcg

SEQ ID NO: 374168 - DNA, 556 bp, Homo sapiens
  misc_feature: GZ8MTXP02JQK8U.17.31.C09.1.454.CMB.2.raw
  modified_base (340)..(340): a, c, t, g, unknown or other
  modified_base (386)..(386): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttacccaacagaacgcctggaccaacgcccccaggacactgatttancgataacaaacaaacaaacactcctcgaccccctgaccccggttcncacggcctcccgtcggttggggcaaacgctcgcccgtcgtacccgttcgggtcgccgcgacgtccgtggaggacgtgaggcgtagagttattactgtcttgctctcctagtcgtggtcggttcggtgttcggcggaggacaagctacgcgtcgtacggtcgacgtacccg

SEQ ID NO: 374169 - DNA, 604 bp, Homo sapiens
  misc_feature: GZ8MTXP02G83L6.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtcccccaggagggacagtcactctcacctgtggctccagcactggagctgtcaccaatggtcattatccctactggttaccaacagaagcctggccaagcccccaggacactgatttatgatacaaacaacaaacactcctcggacccctcgcccggttctcaggcctcccgtccggttcggggacaaacgctcgcccctgtcccgtttcgggtgccgcacgcctgagagtgaggcgtgagtagttacgtgtcgttcgtctctccttacttagtggttggttcgggttgggtttcgggtcgggtacgggaccggaacggtacgtcgtaccggtaccgtacgtacgacgaccgacggaccgtccgccccgccgttttttttccgactcgtccgtccctacccctccctccctactcctacgtccg

SEQ ID NO: 374170 - DNA, 651 bp, Homo sapiens
  misc_feature: GZ8MTXP02JM5HW.17.31.C09.1.454.CMB.2.raw
  modified_base (266)..(266): a, c, t, g, unknown or other
  modified_base (271)..(271): a, c, t, g, unknown or other
  modified_base (294)..(294): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtaccaacagtgtctattactccctagttcgtaccaanagacncgtcgaccaccgcccgagacacngtattatgaataaacaaacaaaccaacgtacctaccgaccgtacccgtcgtcccgttctacgacgtcctccggttcggggtcggggaacaacgtccgtcgtcccgtacggttccccggtttcgggcgccgacgacgtccgtagggaggagtcggaggtcgtagtagtttagttacgtcggtcttcgtccttaccgttacgttagttgggtttgggttcgggtttcggggttacgggttcggggacggggacgaaccgtacgtcgtacggtcccgttacgtcgaacgaccgacggacgccgtcccgccccgtcgacctcgtcctccggtcccctacccgtctccgtctaccgcgtcgg

SEQ ID NO: 374171 - DNA, 597 bp, Homo sapiens
  misc_feature: GZ8MTXP02HSAHD.17.31.C09.1.454.CMB.2.raw
  modified_base (336)..(336): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtcattactccctactggttccaacagaacgcctggccaagcccccaggacactgattangaatacaaacaacaaacacctcctcggacccctagcccggttcctccgacggtccttccccgtcgggttcgggggactaaacgctcgcccgttgtacccgtttcgggtcgccgcacgcctgaggatgaggctgagtattacgtgcttgcttcgtccttagttaggttgggtcggtttcggggttcggtttccggggacggggtacgggaaccgtaacggccgttacggtacccggtccgttaacggttccacggaccccgg

SEQ ID NO: 374172 - DNA, 568 bp, Homo sapiens
  misc_feature: GZ8MTXP02JYOPK.17.31.C09.1.454.CMB.2.raw
  modified_base (297)..(297): a, c, t, g, unknown or other
  modified_base (406)..(406): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaacactcctcggacccctgcccggttctcagctcctcgtggggcaaagctgccctgcccgttgggcgcgcagcctgagatgaggctgagtattacngtcttgcttctcctatagtcggtgtttcgggtgttcgggcggtagggaccaaggcgtgacccgttcgtaaggtccgacgccccgaaggcccgtcggccccccgttcggtcctacctcccgttcgttcccccacccttccctcccgtacggttcctacgtccg

SEQ ID NO: 374173 - DNA, 556 bp, Homo sapiens
  misc_feature: GZ8MTXP02IC0QR.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattccccaggctgtggtgactcaggagccctcactgactgtgtccccaggagggacagtcactctcacctgtggctccagcactggagctgtcaccaatggtcatatccctactggttccaacagaagcctggccaagcccccaggacactgatttatgatacaaacaacaaacactcctgaccccctgcccggttctcacggctccctcgttgggggcaaagctacggccctcgaccctttcgggtcgccgcagcctgacggagtgaggctgagtattatgtctttgcttctccttatgttggtgttcggggtggtttccgggacggtacggggaccgaaggtcgtacgtacccggtccgtacgggtcaacggccccgg

SEQ ID NO: 374174 - DNA, 727 bp, Homo sapiens
  misc_feature: GZ8MTXP02G2L0E.17.31.C09.1.454.CMB.2.raw
  modified_base (297)..(297): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaacgcccccaggacactgatttangatacaaaacaacaaaacactcctacgacccctcgacccggttctccaggcctcccgtccggttcgggggacaaaagcgtcgcccctcggtaccccgtttcggggtcgccggccgacgcccgtagaagggtagttggaagggcgtagaaggttaacttactcggtcttcgtccttccgttacccttagttaacggttggggttggtttccgggggttggtttaccgggggtacggggaacgggtaaccgaaaggtccgtacggtaccccgttacccgtacgggtaccgaaccgggacccccgaaaagggtcccgtcccgggtcccccccggttaccgggttccccaacccgtttccgttccccggtttccccccggtcccccgtttcccccttcccgtttaaaccggttcccgtttaaacccgtcccggg

SEQ ID NO: 374175 - DNA, 567 bp, Homo sapiens
  misc_feature: GZ8MTXP02HLUE5.17.31.C09.1.454.CMB.2.raw
  modified_base (335)..(335): a, c, t, g, unknown or other
  modified_base (378)..(378): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaaacagaagcctggccaagcccccaggacactgatttanagataacaaacaacaaacactacctcgaccctcgtcccgttcncgacgcctcccgtcgtcgggacaacgctcgccctcgtccgttcggcgcgcgacgcgtgaggagtgaggcgtagtagttattacgtcgtcgttcgtctctacgttagtaggttgggttcggttcggggttacggttcgggacgggacggaccgaagtcgtacggtaccgtaccgtacggtaccgacgccg

SEQ ID NO: 374176 - DNA, 554 bp, Homo sapiens
  misc_feature: GZ8MTXP02FMM1P.17.31.C09.1.454.CMB.2.raw
  modified_base (378)..(378): a, c, t, g, unknown or other
  modified_base (410)..(410): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctcctccgttggggcaaagctgccctgcccttcgggngcgcagcctgaggatgaggctagagtattacngtcttgcttcgtcctagtacgtggtgttcgggtgtttcgggcggtagggaccaaggctcggaccgtccgtaggctacgcccaaaggcctcggccccctcggtccactccgtcgttccccaccctcctcctacgtcctacgtccg

SEQ ID NO: 374177 - DNA, 626 bp, Homo sapiens
  misc_feature: GZ8MTXP02J0EV7.17.31.C09.1.454.CMB.2.raw
  modified_base (340)..(340): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttacccaacagaacgcctggcccaacgcccccaggacactgatttangatacaaacaaacaacacctcctcggacccctgccccggttctcgacggtcctccccgtcgggttcgggggacctaaacgcctcggcccctcggtaccccgtttcggggtcgccggccgacgcccgtaggaggacgtggacgggccgtaggtagtacttacgtgtcttcgccttctccgttagtacggttggggttcggtttcgggggttcggttccgggggacgggtaacggggtaccggaaggtccgtacggtacccggtccgtacgggtccgacggaccccgg

SEQ ID NO: 374178 - DNA, 543 bp, Homo sapiens
  misc_feature: GZ8MTXP02GVMGX.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaagcccccaggacactgatttatgatacaaacaacaaacactcctggacccctgcccgttctcaggcctcctcgtggggcaaagctgccctgccctttcgggtgcgcacgcctgacggatgaggctgagtattactgcttgctctcctatagtggtgtttcgggtgttcgggcggagggaccgaagcgtcggaccgtcgtaggtcacgcccgaagggcctcgccccctcggccacgtctcgttccccacctcctcctacgtcctacgtcg

SEQ ID NO: 374179 - DNA, 538 bp, Homo sapiens
  misc_feature: GZ8MTXP02HUD6U.17.31.C09.1.454.CMB.2.raw
  modified_base (338)..(338): a, c, t, g, unknown or other
  modified_base (380)..(380): a, c, t, g, unknown or other
  modified_base (395)..(395): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtcccccaggagggacagtcactctcacctgtggctccagcactggagctgtcaccaatggtcattatccctactggttccaacagaagcctggccaagcccccaggaccactgatttatgataacaaacaaacaaacactcctgacccctgcccgttncaggctcctcgtggggcaaagctgccctgcccgtttcgggcnccgctagcctgacgntgagctgatattactgcttgctatctatagtggtgtttcgggtgttcgggcgggtaggaccgtaagcgtcgaccgtccgtaggtcacgcccgaaggctcgcccctcggcactctcgtccctacctcctcctacgtcctacgcg

SEQ ID NO: 374180 - DNA, 546 bp, Homo sapiens
  misc_feature: GZ8MTXP02GQY8P.17.31.C09.1.454.CMB.2.raw
  modified_base (375)..(375): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggaccactgatttatgatacaaacaacaaacactcctggacccctgccgttctcagctcctcgtggggcaagctgccctgccctttcgggngcgcagcctgacgatgaggctgagtattactgtcttgctctccttatagttggttgttcgggtgttcggggcggtacgggaccaaggctggaccgtcgtaggtcacgaccgaggctacgcccccgtcggcctacgtctcgttccccacccttcctcctacgtcctacgtcg

SEQ ID NO: 374181 - DNA, 567 bp, Homo sapiens
  misc_feature: GZ8MTXP02HXD7T.17.31.C09.1.454.CMB.2.raw
  modified_base (298)..(298): a, c, t, g, unknown or other
  modified_base (338)..(338): a, c, t, g, unknown or other
  modified_base (525)..(525): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtcccccaggagggacagtcactctcacctgtggctccagcactggagctgtcacaatggtcattatccctactggttccaacagaagcctggccaacgcccccaggacactgatttangatacaaacaacaaacactcctggacccctgcccggttcncaggctcccgtcgtggggcaaagctgccctgcccgtttgggcgcgcagcctgaggatggaggctgagtattacgtgcttgctctctattagtggttggtttcgggtggtttcgggcgggtagggaccaaggtccgtggacccgtcgtagggtcgacgcccgaaaggcctccggtccccctcggtccncttccgtcgttcccccgccttcccctcttaccgtctacgccg

SEQ ID NO: 374182 - DNA, 559 bp, Homo sapiens
  misc_feature: GZ8MTXP02F3ZA3.17.31.C09.1.454.CMB.2.raw
  modified_base (375)..(375): a, c, t, g, unknown or other
  modified_base (442)..(442): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctcggacccctgcccggttctcagctcctccgtggggcaagctgccctgcccttcggngcgcagcctgagatgaggctgagtattactgtcttgctctctagtagtggtgttcgggtgttcgggnggacgggaccaaggcgtcggaccgttccgtaggtcacggcccgaaggcctaccgccccctcggtccaccgttccgtccgttcccccacccttccctcccttacggtcctacggtccg

SEQ ID NO: 374183 - DNA, 563 bp, Homo sapiens
  misc_feature: GZ8MTXP02JZAMS.17.31.C09.1.454.CMB.2.raw
  modified_base (377)..(377): a, c, t, g, unknown or other
  modified_base (430)..(430): a, c, t, g, unknown or other
  modified_base (446)..(446): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaagcccccaggacactgatttatgataacaaacaaacaaacactctcgacccctcgcccggttcncacgcctcccgtcgttgggggacaaaggctacgccctcgacccttcggggtcncgcacgcctggacggngtggaggtctaggagttattacgtgtcgttgcttctcctagtacgtgggttcggttcggggtggttcgggcggagggtaccaaggtcgtacgtaccgtcgtacggtcacggaccccg

SEQ ID NO: 374184 - DNA, 598 bp, Homo sapiens
  misc_feature: GZ8MTXP02GWEHM.17.31.C09.1.454.CMB.2.raw
  modified_base (280)..(280): a, c, t, g, unknown or other
  modified_base (314)..(314): a, c, t, g, unknown or other
  modified_base (329)..(329): a, c, t, g, unknown or other
tcagcgtagactagcacgaccggtgctcgatttagacgtctcatcaaggaaggaagggctgtagttgatgtgagagtctctgaggatctcctgtaagggttctggatacaggttttccagctactggatcacctgggtgcgccagaagcccggtaaaggcctggagtggatggggaggattgatcccagtgactctcacatcaaactacacgcccgtccttccaaggccacgtcaccatctcagctgacaagtccatcagtactgccttctgcagtggcncagcctggacgcctcggacaccgcatatattacngtgcgagtccggtancgcccgcagatcactactactcgtacggtctgggaccgtcgtgggggacccaaagggacccacggtccaccgtcctccctccaccctcccaaccgaacgggcccacgtccggttcccttcccccgtcggccctaccccgtccctacccgaaacgaccgaccacccgttcggcgggggaccacgcgccggcccgtcgggcctcggcccgttcggaccgaacggtacccttaaccgttcccgtacgtacctaccgctcggacggcgggtcg

SEQ ID NO: 374185 - DNA, 588 bp, Homo sapiens
  misc_feature: GZ8MTXP02H5OV1.17.31.C09.1.454.CMB.2.raw
  modified_base (299)..(299): a, c, t, g, unknown or other
  modified_base (342)..(342): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggtaccaacagaagcctggaccaacgcccccaggacactgatttangaatacaaaacaacaaaacactacctcggaccctgcccggttntcacgtcctccgtccggtggggacaagctcgccctcgccctttcgggtcgcgtcgagccgtgagatggaggctaggagtattacgtgtctttgccttcttcctatggttcggttggtttcggggtgttcggggacgggtagggacccaaggcgtagacccgtcgtagccacggaccctaggcctccgcccccgtcggtactccgtccgtccgttccccgtccctcctaccctcgtacccgtcgccg

SEQ ID NO: 374186 - DNA, 563 bp, Homo sapiens
  misc_feature: GZ8MTXP02H3IZQ.17.31.C09.1.454.CMB.2.raw
  modified_base (340)..(340): a, c, t, g, unknown or other
  modified_base (382)..(382): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccgaggagggacagtcactctcacctgtgctcagcactggagctgtcaccaatggtcattactccctactcggttaccaacagaagcctggaccaacgcccccgaggacactgatttanacgataacaaacaacaaacactcctcggaccctgcccgttcncgacgctcccgtcgtgggacaagctcgccctcgtacccgttgggcgcgcgacgccgtaggacggtagtggacggtcgtagtagttattacgtgtcttgcttctcttagtggttggtcggttcggggtcggtttcgggcggtacgggacaaggcgtacggaccgtcgtacggtcacgacccg

SEQ ID NO: 374187 - DNA, 553 bp, Homo sapiens
  misc_feature: GZ8MTXP02ISWVP.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattccccaggctgtggtgactcaggagccctcactgactgtgtccccaggagggacagtcactctcacctgtggctccagcactggagctgtcaccaatggtcattactccctatggttaccaacagaagcctggccaacgcccccaggaccactgattatgatacaaaacaacaaacactcctcggacccctgccccgttctcgaggcctccctcggttggggacaaagctcgccctcgtacccgtttcgggcgcgcagcctggagagtggacggctagagttattacgtgtcttgctctccttagtggtggttggttcgggtgttcggggcggtagggaccaagtcgtggtacccgtcgtacggtcgacgacccg

SEQ ID NO: 374188 - DNA, 534 bp, Homo sapiens
  misc_feature: GZ8MTXP02F1MHH.17.31.C09.1.454.CMB.2.raw
  modified_base (415)..(415): a, c, t, g, unknown or other
  modified_base (449)..(449): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctcggacccctgcccggttctcaggctccgtccgttggggcaaagctgccctgcccgtttcgggtcgcgcagccgtgaggatgaggctgagtattacngtcttgctctctatgtggtgttcgggtgttcggnggaggacagctgacgtcgtagtcacgccgaggctcgcccctcggtcacgttctcgttccccaccgtcctcctacgtcctacgtcg

SEQ ID NO: 374189 - DNA, 552 bp, Homo sapiens
  misc_feature: GZ8MTXP02HIGVQ.17.31.C09.1.454.CMB.2.raw
  modified_base (335)..(335): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctgaccaacgcccccaggacactgatttancgaatacaaacaacaaacactactcggacccctgcccgttctcaggctccctcggttcggggctaaagctcgcccgtgtacccgttcgggtcgcgcacgcctgaggctggagctgagtattactgtcttgctctccttagtaggtggttcggtttcggggtcggttcgggcggggacggaccgaaggcgtacggaccgtcgtacggtcacggacccg

SEQ ID NO: 374190 - DNA, 527 bp, Homo sapiens
  misc_feature: GZ8MTXP02F6Z6O.17.31.C09.1.454.CMB.2.raw
  modified_base (335)..(335): a, c, t, g, unknown or other
  modified_base (492)..(492): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttangatacaaacaacaaacactcctggacccctcgcccggttctcaggctccctcgttgggggcaaagctgccctgacccctttcgggcgcgcacgcctgaggatgagtctgagtatactgcttgctcgtctatacgtgtcgttcggtggttcggacggngggaccaaggctgacccgtctacggtcacgacccg

SEQ ID NO: 374191 - DNA, 539 bp, Homo sapiens
  misc_feature: GZ8MTXP02F3IOC.17.31.C09.1.454.CMB.2.raw
  modified_base (339)..(339): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctcccagcacgtggagctgtcaccaatggtcattactccctactggttccaacagaagcctggccaacgcccccaggaccactgatttangatacaaacaaacaaacactacctcggaccccctcgacccggttctccacggcctcccgtcggttcgggggacaaacgctcgccctcgaccccgtttcgggtcgcgcacgcctgacggagtgagtctgagtattactgcttgctctctagtgtgtgtggtgtcggcgacggacaagcgtcgaccgtcgacggtcacgccg

SEQ ID NO: 374192 - DNA, 654 bp, Homo sapiens
  misc_feature: GZ8MTXP02H2D14.17.31.C09.1.454.CMB.2.raw
  modified_base (263)..(263): a, c, t, g, unknown or other
  modified_base (340)..(340): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattactcccctactggttaccaacgagaacgcctggacccaacgccccaggacactgattancgataacaaacaacaaacactcctcggacccctgtccccggttctcgacggcctcccgtcggtgggacaagctcgcccttgtaccccgttgggtcgcgtcgacgtccgtggacggtagtggacgggtcgttaggaagttacttaacgtttcgcgtttcggtccgttactttacccgttaaagtttcgggtttggggtttcgggttttacgggggttcgggttttccgggggacgggggttaacgggaacccgtaaacgggtccgttacgggtaccccggtttccggtaaacgggttcccgaacggtacccccgg

SEQ ID NO: 374193 - DNA, 646 bp, Homo sapiens
  misc_feature: GZ8MTXP02HOROM.17.31.C09.1.454.CMB.2.raw
  modified_base (226)..(226): a, c, t, g, unknown or other
  modified_base (298)..(298): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattatccctactggttccaacagaagcctggccaacgcccccaggacactgatttangataacaaacaacaaaacactcctcggacccctgcccgttctcacggcctcccgtcggttcggggacaaacgcctgccccgttcgtaccccgttttcggggtcgccgccgtacggccgtagagggagtcggaggtcgtgtaagttattacgtgtctttgcttctccttattaggttggttcggtttcgggttggtttcggggacggacggggtacccaaaggcgtacggaccgttaccgtaggttccgacggcccgaaacggtccgtccgtcccccgttcggtcctaccgttccgttccgttcccccggtacccttcccttacccgttacggtccctttacgtcccgg

SEQ ID NO: 374194 - DNA, 553 bp, Homo sapiens
  misc_feature: GZ8MTXP02JQ435.17.31.C09.1.454.CMB.2.raw
  modified_base (340)..(340): a, c, t, g, unknown or other
  modified_base (388)..(388): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggaccaacgccccccaggaccactcgatttancgactaacaaacaacaaacacctcctcggaccccctgccccggttacncacggcctcccgtcgttcggggacaaagcctcgccctcgtaccccgttcgggtcgcgcacgccgtgacggatgagcgtgagtatactgcttgctcgtctagtgtggtgttcgggtgttcgggcggacggtacgaagcgtacgtaccgtcgtacggtcacgacccg

SEQ ID NO: 374195 - DNA, 530 bp, Homo sapiens
  misc_feature: GZ8MTXP02GBB0X.17.31.C09.1.454.CMB.2.raw
  modified_base (298)..(298): a, c, t, g, unknown or other
  modified_base (415)..(415): a, c, t, g, unknown or other
  modified_base (449)..(449): a, c, t, g, unknown or other
  modified_base (475)..(475): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttangataacaaacaacaaacactcctacggacccctgcccgttctcacgctcctcgttggggcaaagctcgccctgcccgtttcgggcgcgcagcctgaggatgaggctggagtattacngtcttgctctctatgtggtgttcgggtgttcggnggacggacagctgccgtctaggtacnccaggctcgcccctggtccactcttcgtccgcccttactcctagtcctacgctcg

SEQ ID NO: 374196 - DNA, 543 bp, Homo sapiens
  misc_feature: GZ8MTXP02GCO0D.17.31.C09.1.454.CMB.2.raw
  modified_base (307)..(307): a, c, t, g, unknown or other
  modified_base (338)..(338): a, c, t, g, unknown or other
  modified_base (458)..(458): a, c, t, g, unknown or other
  modified_base (521)..(521): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctcccagcactggagctgtcaccaagtggtcattatccctactggttaccaacagaancctggccaacgcccccaggacactgatttangatacaaaacaaacaaacacctcctcggacccctagcccggttctcgacggcctcccgtcggttcgggggacaaaagcgtcgcccctcgtaccccgtttcgggtcgcgcacgcctggagntggaggctgagtattactgtcttgctctctatgtggtgttcggtgtcggcggaggaccaagcngaccgtcgtaggtcacgacccg

SEQ ID NO: 374197 - DNA, 571 bp, Homo sapiens
  misc_feature: GZ8MTXP02J0ST7.17.31.C09.1.454.CMB.2.raw
  modified_base (320)..(320): a, c, t, g, unknown or other
  modified_base (338)..(338): a, c, t, g, unknown or other
  modified_base (432)..(432): a, c, t, g, unknown or other
  modified_base (469)..(469): a, c, t, g, unknown or other
  modified_base (546)..(546): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatcggttccaacagaagcctggccaagcccccaggacactgatttatgataacaaacaacaaacactccncgacccctgcccggttcncaggcctcccgtcggttcggggcaaacgctcgccccttgtaccccgtttggggcgtcgcgacgcctgacgggatggaggctaggagttattacngcttgctcgtctagtagtggtgttcgggtgttcgggnggtaggaccaagcgtcgaccgtcgtacggcacgcccgaggcctccgcccccgtggtccacctccgtccgttaccccncccttccctcctacgtccgacgtcg

SEQ ID NO: 374198 - DNA, 543 bp, Homo sapiens
  misc_feature: GZ8MTXP02G66K3.17.31.C09.1.454.CMB.2.raw
  modified_base (297)..(297): a, c, t, g, unknown or other
  modified_base (320)..(320): a, c, t, g, unknown or other
  modified_base (337)..(337): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaaacactccncgacccctgcccgttcncagctcctcgtggggcaaagctgccctgccctttcgggtgcgcagcctgagatgagctgagtattactgcttgctctcctagtacgtggttgttcgggtgttcgggcggaggtaccgaagcgtcgacccgtcgtaacggtcacgcccgaaggctcgcccctcggtccacctctcgtcccctaccctccctactacgtcctacgtcg

SEQ ID NO: 374199 - DNA, 528 bp, Homo sapiens
  misc_feature: GZ8MTXP02JXU1K.17.31.C09.1.454.CMB.2.raw
  modified_base (297)..(297): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaaacactcctggacccctgcccggtctcagctcctcgtggggcaagctgccctgccctttcgggtgcgcagcctgacggatgaggctgagtatactgcttgctctctatagtggtgttcgggtgttcgggcggtaggaccgaagcgtcgaccgtctagtcagcccaggcctcgcccctcgtccactctcgtccccaccctcctcctacgtctacgtcg

SEQ ID NO: 374200 - DNA, 530 bp, Homo sapiens
  misc_feature: GZ8MTXP02FXQQA.17.31.C09.1.454.CMB.2.raw
  modified_base (334)..(334): a, c, t, g, unknown or other
  modified_base (372)..(372): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgattangatacaaacaacaaacactcctcgaccctgcccgttcncacgctccctcgttggggacaaagctagccctcgacccgtttcggcgtcgcgagccctaggacggatgacgtcgtgacgtattactgtcttgctctctataggtgtgttcgggtgttcggcggaggacgaagctacggaccgtcgtagtcacgacccg

SEQ ID NO: 374201 - DNA, 591 bp, Homo sapiens
  misc_feature: GZ8MTXP02H2K2F.17.31.C09.1.454.CMB.2.raw
  modified_base (299)..(299): a, c, t, g, unknown or other
  modified_base (476)..(476): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtcccccaggagggacagtcactctcacctgtggctccagcactggagctgtcaccaatggtcattatccctactggttccaaacagaagcctggccaagcccccaggacactgatttangataacaaaacaaacaaaacactacctacggacccctgcccggttctcgaggcctccgccgtggggacaaagctgcccttcgcccgtttcggggtcgccgcgagcccgtagaggatcggaggctagagtattactgcttgctctcctattagtggtggtttcgggtggtttacgggngggaggaccgaagcgtacggaccgtccgtaggtccgacgaccccgaagggccctccggtccccctcgggtcctacccttcgtccgttccccaccctcctacctacgtcctacgcg

SEQ ID NO: 374202 - DNA, 529 bp, Homo sapiens
  misc_feature: GZ8MTXP02J2NGM.17.31.C09.1.454.CMB.2.raw
  modified_base (297)..(297): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaacactcctggacccctgcccgtctcaggctcctcgtggggcaaagctgccctgcccttcgggtgcgcagcctgaggatgaggctgagtattactgcttgctctcctatagtggtgttcgggtgttcgggcggaggaccgaagcgtgaccgtcgtaggtcacgcccgaaggctcgcccctcggccacgtctcgttcccgcctccgtacctcgtctacgc

SEQ ID NO: 374203 - DNA, 549 bp, Homo sapiens
  misc_feature: GZ8MTXP02IB3UB.17.31.C09.1.454.CMB.2.raw
  modified_base (297)..(297): a, c, t, g, unknown or other
  modified_base (547)..(547): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctccagcactggagctgtcaccaatggtcattatccctactggttccaacagaagcctggccaacgcccccaggacactgatttangatacaaacaacaaacactcctcggacccctgcccggttctcacggcctccgtccgttcgggggcaaacgctcgccccttgtccccgtttcgggtcgccggcacgcctgacggatgaggctggagtattactgcttgcttctcctattgtggtggtttcgggtgttcgggcggtaggaccaagctggaccgtcgtagtcacgcccaggctcgcccctcgtcactctcgtcccacctcctctacgtctacncg

SEQ ID NO: 374204 - DNA, 533 bp, Homo sapiens
  misc_feature: GZ8MTXP02GM80Z.17.31.C09.1.454.CMB.2.raw
  modified_base (382)..(382): a, c, t, g, unknown or other
  modified_base (413)..(413): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaagcccccaggacactgatttatgatacaaaacaacaaaacactcctggacccctgcccggttctcaggctccctcgttggggcaaaagctgccctgaccctttcgggngcgcagcctgaggatgaggctgagtattacngcttgctctcctatagtggtgttcgggtgttcggcggaggccaagctcgacgtcctaggcacgcccaaaggctgcccctcggtccactctgttccccacctcctcctactcctacgtccg

SEQ ID NO: 374205 - DNA, 594 bp, Homo sapiens
  misc_feature: GZ8MTXP02GC5K3.17.31.C09.1.454.CMB.2.raw
  modified_base (421)..(421): a, c, t, g, unknown or other
  modified_base (477)..(477): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtcccgaggagggacagtcactctcacctgcggctccagcacgtggagctgtcaccaatggtcattactccctactcggttaccaacagaacgcctggccaaacgcccccaaggaccactgtaatttacagataaacaaaacaaacaaacacctcctcgaccctcgccgttctcgacgcctcccgtggtcggggacaacggcncgtccctacgcccgtttcgggcgacgcgacgtccgtaggaggacgttggacgggtntaggaagttagtacgtcgtcttcgcttctactagttggttgggttcggttcggggttggttacgggcgggaaggtaccgaagtcgtacgtacccggtcgtacggtccacgtacccgg

SEQ ID NO: 374206 - DNA, 549 bp, Homo sapiens
  misc_feature: GZ8MTXP02GDJVL.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaagccccccaggacactgatttatgatacaaacaacaaacactcctggacccctgcccggttctcaggctcctccggttggggcaaagctgccctgcccttcgggcgtcgcagcctgacggatgaggctgagtattactgcttgctctcctatagtggtgttcgggtgtcgggtcggaggaccaagcgtggaccgtccgtaggtccacgcccgaaggcctcgccccctcggtacctccgtcgtccgttccccacctccctcctacgtcctacgtcg

SEQ ID NO: 374207 - DNA, 581 bp, Homo sapiens
  misc_feature: GZ8MTXP02I46R8.17.31.C09.1.454.CMB.2.raw
  modified_base (297)..(297): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaacactcctggacccctgccccggttctcagcctcctccggttcggggcaaagctacgccctcgtacccgtttcgggtcgcgccagcctggacggatgaggctgagttattactgcttgctactcctatacgtggttgtttcgggtgttcgggcggagggtaccgaagcgtacggacccgtcgtacggtcacggccccgtaaaggccgtccgcccccgttcggtccaccgttccgtccgttccccgccctccgtcctacgtcctacgtccg

SEQ ID NO: 374208 - DNA, 603 bp, Homo sapiens
  misc_feature: GZ8MTXP02IWJ7J.17.31.C09.1.454.CMB.2.raw
  modified_base (347)..(347): a, c, t, g, unknown or other
  modified_base (414)..(414): a, c, t, g, unknown or other
  modified_base (463)..(463): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctcagcactggagctgtcaccaagtggtctattactccctatcggttaccaacagaacgcctaggaccaaacccgcccccaaggaccactgatttanacgaataacaaaacaaacaaacacctctcgacccctgcccgtactcacgcctcctcgtgggacgaancgtcgcctcgtaccgttcggtcgcgcgcgacgtcgaggagtgaggtcgngtagtagttacgtcgtcgttctcgtaccttccgttaatcgggtttgggttcggtttcgggggttcggtttccggggacggggtaacgggaaccggtaacgacgtcggtacccgtaccgttcgggtaccacggaaaccccg

SEQ ID NO: 374209 - DNA, 535 bp, Homo sapiens
  misc_feature: GZ8MTXP02GHGGL.17.31.C09.1.454.CMB.2.raw
  modified_base (336)..(336): a, c, t, g, unknown or other
  modified_base (345)..(345): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgactttangatacaaanaaacaaacactcctcggacccctgcccggttcctcacggcctccctcggttcggggacaaagctcgccctcgaccccgtttcggtcgcgcacgcctgacggagtgaggcgtgagtatacgtgctgctctcctagtagtggtgttcggtgttcggcggacggacaagctcgaccgtcgtacgcgacgaccg

SEQ ID NO: 374210 - DNA, 551 bp, Homo sapiens
  misc_feature: GZ8MTXP02FFC6O.17.31.C09.1.454.CMB.2.raw
  modified_base (397)..(397): a, c, t, g, unknown or other
  modified_base (430)..(430): a, c, t, g, unknown or other
  modified_base (464)..(464): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctatcggttaccaacagaacgcctggaccaacgcccccgaggacacgtgtatttatgataacaaaacaacaaacactcctacgacccctcgcccggttctcgaggcctccgtccggttggggacaaagctcgccctgtcccttcgggncgcgagcctgagatggagtcgtagagtattacngtcttgctctctatagtggtggttggtgtcgggnggacggtacagctcgaccgtcgtagcacgccgaggctccgccccgtcgtcacgtccgtcgtcccctccctcctccgttgacctcgcg

SEQ ID NO: 374211 - DNA, 557 bp, Homo sapiens
  misc_feature: GZ8MTXP02FHZ8L.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaacgcccccaggacactgatttatgataacaaacaaacaaacactcctcggacccctcgcccggttctcaggcctccgtccgttggggcaaagctgcccctgtcccgttcgggtcgcgcacgccgtgaggatggaggctgagtattactgtcttgctctctatagtggtgttgggtgttcgggcggacggacaagctgccgtcgtaggcacgcccaaggctccgcccccgtcggtccacgttcctcgttccccctacccctcctcccgtacgtccgtacgtccg

SEQ ID NO: 374212 - DNA, 534 bp, Homo sapiens
  misc_feature: GZ8MTXP02JKT1D.17.31.C09.1.454.CMB.2.raw
  modified_base (337)..(337): a, c, t, g, unknown or other
  modified_base (477)..(477): a, c, t, g, unknown or other
  modified_base (503)..(503): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaacgcctggccaacgcccccaggacactgatttancgatacaaaacaacaaacactcctcggaccccctgccccggttctcacggcctcccgtcgttcggggcaaacgcgtcgcccgtcgccccgttcgggtcgcgcagccgtggacggatgaggctgagtatactgcttgctcnctatgtggtcgttgggtgtcggcggnggacaagctacgacgtcgtacgtcagacccg

SEQ ID NO: 374213 - DNA, 596 bp, Homo sapiens
  misc_feature: GZ8MTXP02H9DV6.17.31.C09.1.454.CMB.2.raw
  modified_base (348)..(348): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctacttcggttcccaaacagaacgccgtcggacccaacgcccccaaggaccacttgatttanacgaataacaaaacaaacaaacaccttaccctcggaccccctgcccccgttctccgacgggtccttcccgtcggttcgggggacaagctacgcccttcgtacccgtttcgggtcgccgtcgacgccgtggaggagtgagggctgagttatacgtgcttgcttctccttagtaggttggtgtttcggggtgttcggggcgggtacgggaccgaagtcgtacggtccgtaccgtacggtcgacgacccgg

SEQ ID NO: 374214 - DNA, 645 bp, Homo sapiens
  misc_feature: GZ8MTXP02I4BHG.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcccctatggttccaacagaagcctggccaacgcccccaggacactgatttatgataacaaacaacaaacactctcgaccctgcccgttctcgacgcctcctacggttcggggacaaacgctcgccccttcgcccgtttcgggtcgcgcctacgccgtaggaggtagtggaggcgtaggtacgttattacgtcgtctttggccttctccgttaagttcggttgggtttcggtttcgggggttcggtttcgggggaccggtacggggaccgaaggtccgtacggtacccggtacgtaacggtcgaacggccccggaaacggtccgtccggtcccccgtcggtaccctaccgttccgtcccgttcccccgtccttaccctccgtttcgtacccgtacgtccg

SEQ ID NO: 374215 - DNA, 588 bp, Homo sapiens
  misc_feature: GZ8MTXP02H6EG6.17.31.C09.1.454.CMB.2.raw
  modified_base (381)..(381): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtcccaggagggacagtcactctcacctgtggctccagcactggagctgtcaccaatggtcattactcctactcggttccaacagaagcctaggcccaaacgcccccaggacactgtacttatcgaataacaaacaacaaacactcctcgaccctgcccgttcncgacgctccctcgtgggcaagctcgcctcgtaccttcgggcgtcgctacgccgtggaggacgttaggaggtcgtagtagttacttacgtgtcgttcgcttcgtaccgttagtggttgggttcgttcgggggttcggttccggggcggggacgggaccgtaacggtacgtacggtaccggtaccgtacggtaccgtacggaaccccgg

SEQ ID NO: 374216 - DNA, 605 bp, Homo sapiens
  misc_feature: GZ8MTXP02GN6DK.17.31.C09.1.454.CMB.2.raw
  modified_base (344)..(344): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccgaggagggacagtcactctcacctgtggctccagcactggagctgtcaccaatggtcattactcccctactggttcccaacagaacgcctggaccaacgcccccgaggaccactgatttangatacaaacaacaaacactcctcggacccctggtcccggttctccgaggtcctcccgtcggtggggaccaagcgtcgccctcgtaccccgtttgggcgtccgacgacgcccgtggaggcgtggacggtcgtagagttacttacgtgtcttgtcctcttccgttaagtcgggttggttcgggtttcggggtcggtttccggggacggggtacgggaccgtaacggtcgtacggtacccgtacgtacggtccgacgaccccgg

SEQ ID NO: 374217 - DNA, 604 bp, Homo sapiens
  misc_feature: GZ8MTXP02GXT8A.17.31.C09.1.454.CMB.2.raw
  modified_base (415)..(415): a, c, t, g, unknown or other
  modified_base (426)..(426): a, c, t, g, unknown or other
tcagcgtagactagcacgaccggtgctcgatttagacgtctcatcaaggaaggaagggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggatctctgaggatctcctgtaagggttctggatactaggttttccagctactggatcaccgtgggtgcgccagaacgcccggtaaaggcctaggagtggagtggggagtagttgactccgagtgactctcacatacaactacacgccctctaccaacggccacgtcaccatctcagctgactaagccatcagtacncgtcccttccngccgtagcggccgactcggcccgtggggacgccctcgggaaccacccggtaccaattatactttacgcgttcgacgtaacggttcccggttatcccgaccggacaacgtactaccgtaaccttaaccgttaacctaaccgttacggtccgtaacgggtaccgttcggtaacccggggg

SEQ ID NO: 374218 - DNA, 667 bp, Homo sapiens
  misc_feature: GZ8MTXP02FI75C.17.31.C09.1.454.CMB.2.raw
  modified_base (345)..(345): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcgaggagcccctcactgactgtcgtccccaggagggacagtcactctcacctgtggctccagcactggagctgtcaccaatggtcattactccctactcggttccaacagaacgcctggcccaaacgcccccaggtaccactgatttanagataacaaaacaaacaaacactcctcgaccccctcggtcccggttctccgacgggtcctccccgttacgggttcggggactaaacgccgtcggaccccgtcgtacccccgtttcggggtacaccgaccacggtacccttgggaaacggtagtgaacggtcgtaggaacgttattacgtcgttcgttgtaccttccttaccgtagttacggtggggttcggggttcggggttcgggtttaccggggaccggggtaacggtaaccggaaacgtcccgtacggtaacccggttccggtacgggtacccgacggtaacccccggg

SEQ ID NO: 374219 - DNA, 600 bp, Homo sapiens
  misc_feature: GZ8MTXP02HQUYR.17.31.C09.1.454.CMB.2.raw
  modified_base (397)..(397): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggacactgatttatgataacaaaacaaacaaaacactacctacggaccccctgacccggttctccaggcctccgtccggttggggacaaacgctgcccctgcccgtttcgggnaccgcacgcccgtagaggagtagaggcgtagtagtattacgtcgtcttcgtctctacttagttagttggttggtttcgggttgggttcgggtacgggacggacgaacgacgtcgtaccgtaccgtacgtacgtacgaccgacgtcgtccgtccccgtccgtcctcctctccgtccctaccctccctcctaccgtcgtacgtcg

SEQ ID NO: 374220 - DNA, 591 bp, Homo sapiens
  misc_feature: GZ8MTXP02IEM1Q.17.31.C09.1.454.CMB.2.raw
  modified_base (226)..(226): a, c, t, g, unknown or other
  modified_base (303)..(303): a, c, t, g, unknown or other
  modified_base (326)..(326): a, c, t, g, unknown or other
  modified_base (528)..(528): a, c, t, g, unknown or other
  modified_base (571)..(571): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattactccctactcggttaccaacagaagcctggccaacgcccccaggaccactgtatttangataacaaacaaacaaacactcncgaccctgtcccgtctcgacgcctccgtcggtcggggacaaacggctcgtcccgtgtccccgtttgggtcgccgcgtacgccgtagacggatggaggtcgtgagttattacgtgtctgccttctaccgtagttaggtcgggttggtttcggggtgttcggggcggtacgggacctaaggcgttcggaccgttcgacggtacncgacccgaggcctcgccccgtcgtcctactccgtccgtacccncctcctactcgtcttacgcg

SEQ ID NO: 374221 - DNA, 647 bp, Homo sapiens
  misc_feature: GZ8MTXP02H2I4B.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtcccaggagggacagtcactctcacctgtggcctccagcactggagctgtcaccaatggtcattactcccctactcggttaccaaacagaacgcctaggaccacgacccccaggacactgtattatcgaataacaaacaaacaaacactaccgcgtaacccctgccccggttctccgacggccttcccgtcggttcgggggacaaacgctacgcccgtcgtaccccgttcgggtacgcggtcacgccgtaggacggagtgaggcgtaggagttaacgtacgttcggtcttcggtccttccgtaccgttagttacgggtttcgggtttcggtttcgggggttcggtttaccgggggaccggggtacgggtaaccggtaacgtccggtacggtacccggttaccgtacggttaccgaccggtaaccccgg

SEQ ID NO: 374222 - DNA, 530 bp, Homo sapiens
  misc_feature: GZ8MTXP02I2SU6.17.31.C09.1.454.CMB.2.raw
  modified_base (455)..(455): a, c, t, g, unknown or other
  modified_base (496)..(496): a, c, t, g, unknown or other
  modified_base (514)..(514): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaaacactacctcggacccctgcccggttctcacggcctccctcgttcggggcaaagctcgccctgccctttcgggtcgccgcagcctgacgatggagctgagtattacgtgtcttgctctctatgtggtgttcgggtgttcgggnggaggacagctgccgtcagtcacgccaggctcgccctcgcnctctcgtcccgccttccncctacgtcctacgtcg

SEQ ID NO: 374223 - DNA, 536 bp, Homo sapiens
  misc_feature: GZ8MTXP02F5KJC.17.31.C09.1.454.CMB.2.raw
  modified_base (335)..(335): a, c, t, g, unknown or other
  modified_base (355)..(355): a, c, t, g, unknown or other
  modified_base (372)..(372): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttangatacaaacaacaacactcncggaccctgcccgttcncagctcctcgtggggcaaagctgccctgccctttcgggtgccgcagccctggacggatggaggcgtagagttattactgtcttgctctccttaagtcggttggttcggttcgggtcggttcgggcgggtagggaccaagcgtcgaccgtcacggtcacgacccg

SEQ ID NO: 374224 - DNA, 556 bp, Homo sapiens
  misc_feature: GZ8MTXP02H5BAO.17.31.C09.1.454.CMB.2.raw
  modified_base (242)..(242): a, c, t, g, unknown or other
  modified_base (264)..(264): a, c, t, g, unknown or other
  modified_base (348)..(348): a, c, t, g, unknown or other
  modified_base (394)..(394): a, c, t, g, unknown or other
  modified_base (439)..(439): a, c, t, g, unknown or other
  modified_base (455)..(455): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgccagggtccaattccccaggctgtggtgactcaggacgccctcactgactgtcgtccccaggagggacagtcactcncacctgtggctcagcactgganctgtcaccaatggtcattactccctactggttaccaacgagaacgccgtggacccaaacgccccccaaggaccacgtgatttangaataaccaaaacaaacaaacactcctcggacccctgcccggttcncgcgctccctcggtggggcaagctcgccctgtacccgtttgggcncgcacgccgtgaaggntggagtcgtgagtattctgtcgttgcttctcctagtgttgggtgttcggggtgttcgggcggtaggaccaagtccgtcgaccgtcgtacggtcaacgcccg

SEQ ID NO: 374225 - DNA, 591 bp, Homo sapiens
  misc_feature: GZ8MTXP02G7673.17.31.C09.1.454.CMB.2.raw
  modified_base (342)..(342): a, c, t, g, unknown or other
  modified_base (369)..(369): a, c, t, g, unknown or other
  modified_base (388)..(388): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtcattactccctactggttaccaacagaacgcctcggaccaacgcccccaggaccactgatttanacgaactaacaaacaacaaacactccncggacccctggcccgttcncacggcctccgtcggtcggggacaacgctcgcccgtgtacccgttgggcgcgcacgcctaggaggtgtggagtcgtaggtagtattactggtcttgtctcgtcctagttacggttggttcggtttcggggtcgttcggggaccgggtacgggaaccgtaaggtccgtccggtacccgtaccggtacggtcccgacggaccccg

SEQ ID NO: 374226 - DNA, 590 bp, Homo sapiens
  misc_feature: GZ8MTXP02JJGF7.17.31.C09.1.454.CMB.2.raw
  modified_base (263)..(263): a, c, t, g, unknown or other
  modified_base (341)..(341): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattactcccctatcggttaccaacagaacgcctggacccaacgcccccaggacactgatttangataacaaaacaacaaacactcctcggaccccctggccccggttctcgacggtcctcccgtcggttcgggggacaaacgctcgcccctcgtaccccgtttcggggtcgccgcgacgcccgtggaggagtggaggcgtgagtattactgtcttgctcgtctagtaggtggtcggttcgggtcggttcgggacgggtacgggaccgaaggtccgtacggtacccggtaccgtacggtaccgacgaccccgg

SEQ ID NO: 374227 - DNA, 636 bp, Homo sapiens
  misc_feature: GZ8MTXP02JPZ19.17.31.C09.1.454.CMB.2.raw
  modified_base (408)..(408): a, c, t, g, unknown or other
  modified_base (491)..(491): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagcccctcactgactgtcgtccccaggagggacagtcactctcacctgtggctccagcactggagctgtcaccaatggtcattactccctactcggttacccaacagaacgccgtggaccaacgcccccgaaggaccacgtcgtaatttatacgaactaacaaaacaaaccaaacaccttccctcggaccccctcgtaccccggttcncgacggtcctcccgtcgggttcgggggaccaaacgcgtcgcccgttacgtaccccgtttcgggcgccgcgacgccgtggaggngtggaggcgtaggagttattacgtggtcttcgccttcgtaccgttaagttcggttggggttcggttcgggggttcggttccgggggacgggtacggggacccgtaaggcgtacggaccggtaccgtacggtaccgacgaccccgg

SEQ ID NO: 374228 - DNA, 587 bp, Homo sapiens
  misc_feature: GZ8MTXP02F2JPZ.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttaccaacagaagcctggccaacgcccccaggacactgattatgatacaaacaacaaacactcctgacccctgcccgttctcagcctcctccggtggggcaagctcgccctcgtcccgtttgggtcgcgcagcctgaggatgagctgatattactgtcttgctctcctagttacggttggttcggtttcgggttgtttcggggacggtaacgggaccgaaggcgtcgacccgttccgtaggtaccacggcccgaagggcctccggcccccgttcggtcctaccgttctcccgttacccctaccccttccctaccgtacgtccgtaccgtccg

SEQ ID NO: 374229 - DNA, 587 bp, Homo sapiens
  misc_feature: GZ8MTXP02FHZ05.17.31.C09.1.454.CMB.2.raw
  modified_base (420)..(420): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaaacactcctcggacccctgacccggttctcaggctcctccgttggggcaaagctgccctgtccccgttcgggtcgtcgcgagccgtgaggatggaggctgagtattacngtcttgctctcctatagtggttgttcgggtgttcgggcggtaggggacaaggcgttcggaccgtccgtaggtcgacggacccgaaggtccgtccggcccccgtcgggtaccctaccttccgtcgtttccccctacccgtcccctccgttaccggtcctacggtcccg

SEQ ID NO: 374230 - DNA, 556 bp, Homo sapiens
  misc_feature: GZ8MTXP02J0BHN.17.31.C09.1.454.CMB.2.raw
  modified_base (380)..(380): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaaacactcctcggacccctgcccggttctcaggcctcctcgtggggcaaagctgccctgccctttcgggngcgcagcctgaggatgaggctgagtattatgcttgctctcctatacgtggtggttcgggtgttcgggcggagggaccgaaggctggacccgtccgtaggtccgacgccccgaaggcctcgcccccgtcgcctaccgtcgtccgttccccgccctcctaccgtcgtccgtacgtccg

SEQ ID NO: 374231 - DNA, 528 bp, Homo sapiens
  misc_feature: GZ8MTXP02FHSDQ.17.31.C09.1.454.CMB.2.raw
  modified_base (408)..(408): a, c, t, g, unknown or other
tcagcgtagactagcacgaccggtgctcgatttagacgtctcatcaaggaaggaaggggaccaggggtcccttccaatatcagcaccatgggcctggactcctctctttctgttcctcctcacttgctgcccagggtccaattcccaggctgtggtgactcaggagccctcactgactgtgtccccaggaggacagtcactctcacctgtggctccagcactggagctgtcaccaatggtcattatccctatggttccaacagaagcctggccaagccccccaggacactgatttatgatacaaacacaaacactcctggacccctgcccggttctcaggctcctccgttggggcaaagctgccctgcccttcgggtgcgcagcctgaggatgaggctgagtattacngcttgctctcctatagtggtgttcgggtgttcgggcggagggaccaaggctgaccgtcctaggtcagcccaaggctgccccctcggtcactctgtccccgccctcctacctcgctacgcg

SEQ ID NO: 374232 - DNA, 573 bp, Homo sapiens
  misc_feature: GZ8MTXP02HG18X.17.31.C09.1.454.CMB.2.raw
  modified_base (337)..(337): a, c, t, g, unknown or other
  modified_base (464)..(464): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaaacgcccccaggaccactgatttangataacaaacaacaaacactcctcggaccccctgaccccggttctccgacggcctccctcggttcgggggaccaaaggcgtcgccccgtgtaccccgtttcggggtcgccgcacgtccctggaaggngtggaggtcgtgagttattacgtgtctttgctctcctatggtggttggttcggggtcgttcgggcggtacgggaccgaagcgttacgaccgtcgtacggtcacgacccg

SEQ ID NO: 374233 - DNA, 635 bp, Homo sapiens
  misc_feature: GZ8MTXP02GCAYE.17.31.C09.1.454.CMB.2.raw
  modified_base (506)..(506): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtccccaggagggacagtcactctcacctgtggctcagcactggagctgtcaccaatggtcattatccctactggttcccaacagaacgcctcggccaacgcccccaggaccactgtactttatgataaccaaaacaacaaaacacctcctcgggaaccccctgccccggttctccgacggtcctcccgtcggttcgggggaccaaagtccgtacgccccgttacggtaccccgtttcggggtcgccgacgacgtcccgtaggacggagtgggagtccgtgaacgttnttaaccgtggtcgttgccttcgtacctaagttcggttgggttcgggtttcggggtacggtttccgggggacgggaacgggtaccgaaaggtccgtacggtaccgtccgtaacggtcgaccgtaacccgg

SEQ ID NO: 374234 - DNA, 583 bp, Homo sapiens
  misc_feature: GZ8MTXP02JSNJE.17.31.C09.1.454.CMB.2.raw
  modified_base (335)..(335): a, c, t, g, unknown or other
  modified_base (382)..(382): a, c, t, g, unknown or other
  modified_base (463)..(463): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttancgatacaaacaacaaacactacctcggaccccctagccccggttacncacggcctcccgtcgttcgggggaccaaaggctacgccctacgtaccccgtttcggggtgccgaccagcccgtgaacgggntggaggtctaggaggttattactggccttggcctctccttataggttgggttggttcggggttgttcggggcgggtagggacccgaagcgtacggaccgtccgtaaggtccacggacccg

SEQ ID NO: 374235 - DNA, 628 bp, Homo sapiens
  misc_feature: GZ8MTXP02JYTMP.17.31.C09.1.454.CMB.2.raw
  modified_base (343)..(343): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaagcccccaggacactgatttatgataacaaacaacaaaacactacctcggacccctgccccggttcncacggcctcccgtcgtggggcaaagctgccctgtcccgttcgggtcgcgcgacgccgtgaggagtgagcgtagtagttaattacgtgtcttgtaccttcctaccttagtaggttgggttgggttcgggttcgggttcgggacgggtaacggaccgaagtcgtacgtacccggtacgtaggtaccacggacccgaaggtcccgtacccggcccccgttacggtccctaccgttccgttccgttccccccaccccgtttcccttacccgtacgttccgtaccgtccg

SEQ ID NO: 374236 - DNA, 540 bp, Homo sapiens
  misc_feature: GZ8MTXP02FMO0I.17.31.C09.1.454.CMB.2.raw
  modified_base (296)..(296): a, c, t, g, unknown or other
  modified_base (406)..(406): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaagcccccaggacactgatttangatacaaacaacaaacactcctgacccctgcccggttctcaggctcctcgttggggcaaagctgccctgcccttcgggcgtcgcagcctgagatgaggctgagtattacngtcttgctctcctatgtggtgttcgggtgttacggcggaggtaccgaagcgtgaccgtcgtaggtcacggcccgaaggcctcggccccctcggtccacgttcctcgttccccgccctcctcctacgtctacgcg

SEQ ID NO: 374237 - DNA, 581 bp, Homo sapiens
  misc_feature: GZ8MTXP02JYSPL.17.31.C09.1.454.CMB.2.raw
  modified_base (337)..(337): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggaccaacgcccccaggacactgatttangataacaaacaaacaaaacactacctcggaaccccctggccccggttctcacggtcctcccgtcgttcgggggacaaagctcgccctgtacccgtttcgggtcgcgtcgacgccgtgacggatgagggcgtgacgtattacgtcgtcttgctctccgtattaggtggttcggttcggggttcggttcgggcgggacggggtacgaacggcgtacggacccggtacgtacggtcgtacgacccgg

SEQ ID NO: 374238 - DNA, 581 bp, Homo sapiens
  misc_feature: GZ8MTXP02F1GDG.17.31.C09.1.454.CMB.2.raw
  modified_base (336)..(336): a, c, t, g, unknown or other
  modified_base (381)..(381): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtcattatccctatggttccaacagaagcctggccaacgcccccaggacactgactttangataacaaaacaacaaacactacctcggacccctcgtcccgttcncaggcctcccgtcgtcgggggacaaacgctcgccctacgtacccgtttcgggtcgcgcgacgcctaggaggagtggacgcgtgtagtattactgtcttcgcttctccttagtaggtggttcggttcgggttcggttcgggggcggtacggggaccgaaggtccgtacgtacccggtccgtacgggtaccacggaacccgg

SEQ ID NO: 374239 - DNA, 663 bp, Homo sapiens
  misc_feature: GZ8MTXP02J2VZ7.17.31.C09.1.454.CMB.2.raw
  modified_base (170)..(170): a, c, t, g, unknown or other
  modified_base (295)..(295): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctnactgactgtgtccccaggagggacagtcactctcacctgtggctccagcactggagctgtcacatgtcattatccctatggttccaacagaacgcctggccaacgcccccaggacactgatttangataacaaacaacaaacactcctcgaccctgcccgttctcgacgctccgtcggtcggggacaaacgctcgcccttcgcccgttcgggtcgcgcacgcctaggacggagtggaggtctaggtaaggttacttacgtgtcgttcgccttacttcctagttggtggttgggttcggggttggttccggggacgggacggaccgtaacgggtccgtacggtaccgttaccgttaacgggcctaaccggaccccgtaaacggggcccttacccggtccccccgttcgggtacccctaccggtttccccttcccggtttaacccccccggtccccttcccgttaacccgtaccggtttaccccgtaccggtccg

SEQ ID NO: 374240 - DNA, 565 bp, Homo sapiens
  misc_feature: GZ8MTXP02ITAVL.17.31.C09.1.454.CMB.2.raw
  modified_base (296)..(296): a, c, t, g, unknown or other
  modified_base (384)..(384): a, c, t, g, unknown or other
  modified_base (398)..(398): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggtccaacagaagcctggccaacgcccccaggacactgatttangatacaaacaacaaaacactcctcggacccctgcccgttctcgacgcctccctccgtcggggctaaagctgccctgcccgtttcgggngcgcagcctgaggntgaggctgagtattactgcttgctctcttagtagtggtgtttcgggtgttcgggaggtacgggaccaggtcgtcgacccgttacgtacggtcacggacccgaaggtcctccgcccccgtcggtccctaccgtctccgtccccgcccttcctcctacgtcctacgtcg

SEQ ID NO: 374241 - DNA, 751 bp, Homo sapiens
  misc_feature: GZ8MTXP02JRHAL.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagcccctcactgactgtcgtccccgaggagggacagtcactctcacctgtggctccagcactggagctgtcaccaagtggtacattactcccctacgtcggtttacccaaacgagtaacgccgtcggacccaaaccggccccccgaaggaccaaccgtggtaactttaagtacgaaaacttaaaccaaaaaccaaaaccaaaaacctaacccgttacccctaccggggtaaacccccccttcgggtaaccccccgggtttcctaccgtaccggggtcccctttacccccggttccgggggttacgggggtaacccgaaaacggtccgtaaccggttcccccgtacggttacccccggtttcgggggtcgtcccggtccgacgtcccgtaggtagggacgttaggacgggtcgtagtaacggttattacgttgtcgttcgtcctcttacccgttagttacgggttcggtcgggtttcggggtcggtttcggggacgggtaacgggaccgtaaggtccgtcgacccggttcgtaacggtccgaccgaacccgg

SEQ ID NO: 374242 - DNA, 614 bp, Homo sapiens
  misc_feature: GZ8MTXP02GHMB8.17.31.C09.1.454.CMB.2.raw
  modified_base (356)..(356): a, c, t, g, unknown or other
  modified_base (496)..(496): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtccccagggagggacagtcactctcacctgtcggctccagcactggagctgtccaaccaagtggtactattactccctactcggttaccaacagaacgcctcggaccaaccggcccccaggaccacgtgtaatttanacgaactaacaaaacaaacaaaacacctacctccggaccccctcggtcccggttctccgacggtcctccccgtgggttcgggggacaaacgtccgtacgtccctcggtacccgtttcgggcgcgcacgccgtgggacggngtgacggtcgtagtagtacttacgtgtcttgcttctcctagttggtgggttcggttgggtcggttcggcgggtacggaacgaaggcgttacggcccgttacgacggtacgacgtaccg

SEQ ID NO: 374243 - DNA, 530 bp, Homo sapiens
  misc_feature: GZ8MTXP02F5BSW.17.31.C09.1.454.CMB.2.raw
  modified_base (297)..(297): a, c, t, g, unknown or other
  modified_base (319)..(319): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtcccccaggagggacagtcactctcacctgtggctccagcactggagctgtcaccaatggtcattatccctatggttccaacagaagcctggccaagcccccaggacactgatttangatacaaacaacaaacactccnggacccctgcccggttctcaggctcctcgtggggcaagctgccctgcccgttcgggtgcgcacgcctgacggatgaggctgacgttattactgtcttgctctctatagtggtgttgggtgttcgggcggaggaccagctggaccgtcgtaggtcacgccgtaaggctcgcccctcggtcactctcgtcccacctcctcctactctacgtcg

SEQ ID NO: 374244 - DNA, 714 bp, Homo sapiens
  misc_feature: GZ8MTXP02HGPOA.17.31.C09.1.454.CMB.2.raw
  modified_base (372)..(372): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtccccagggagggacagtcactctcacctgtcggcctcagcacgtggacgctcgtacacctaagtcggtactattacttcccctacgtcggttaccaacgacgaacgcccgtcggacccaacccgcccccgaaggaccacgtagtacttttanacgtaactaaaccaaaacaaaccaaactaccctaccgtccggtaccccctcggtacccccgtttcgtaccgacggtcccgttcccgggtcggggttacgggggaccctaaacggtccgtccggtcccgtcgttaccccggttcggggtcgtccgccgtacgtccggagggaagggtcgttaggacgggtaccgttaggtaacggttactttacggtcgttcttccgcttccgttaccttagtcgggttgggttcgggtttcggggtcggttccggggaccggggtacggtaacccgtaaggtcgtaccggtaccgtaccgtacggtaccgacggtaccccgg

SEQ ID NO: 374245 - DNA, 578 bp, Homo sapiens
  misc_feature: GZ8MTXP02GTEJT.17.31.C09.1.454.CMB.2.raw
  modified_base (348)..(348): a, c, t, g, unknown or other
  modified_base (394)..(394): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagcccctcactgactgtcgtccccaggagggacagtcactctcacctgtggctccagcactggagctgtcaccaatggtcattactccctactcggttaccaaacgagaacgcctggcccaacgccccccaaggaccactgtatttanacgataacaaaacaaacaaacacctcctcggacccctgcccgttcncgacgcctcccgtcgtcggggacaagctcgcccgtcgacccgtttcgggcgccgcacgctcggaggagtgtacgtgtagagttattacgtgtcttcgtcttctcttagtagttggttcggttcgggttcggttcgggcgggacggacgaacgcgtacggtaccgtccgtacgtcgacgacccgg

SEQ ID NO: 374246 - DNA, 566 bp, Homo sapiens
  misc_feature: GZ8MTXP02FG8LJ.17.31.C09.1.454.CMB.2.raw
  modified_base (337)..(337): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagcccctcactgactgtcgtcccaggagggacagtcactctcacctgtggctccagcactggagctgcaccaatggtcattatcccctactggttccaacagaagcctggccaacgcccccaggaccactgatttangatacaaacaacaaacactcctgacccctcgcccggttctcaggtcctccctcgttgggggacaaagctacgccctcgacccgtttcgggtcgcgcagcctgaggactgatcgtgacgttattactgtcttgcttcgtccttatagtgggttcgttcgggggtcgtttcggggcgggacgggaccaacggcgttacggacccggtccgtaacgggtcacggtaccccgg

SEQ ID NO: 374247 - DNA, 713 bp, Homo sapiens
  misc_feature: GZ8MTXP02I0YZ7.17.31.C09.1.454.CMB.2.raw
  modified_base (226)..(226): a, c, t, g, unknown or other
  modified_base (311)..(311): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtctattactccctactcggttaccaaacgagaacgcctacggaccaacgcccccaggaccactagtatttanagtaataaacaaaacaaacaaaaccgtacctacctaccggaccccctcgtccccggttcctacgaccggtcccttacccgttccggggttacgggggacctaaaacggtccgtacggtcccccgttacgggtacccccgttttcgggggtcgccgcccgtaacggtcccgtagggacggagtggacggtcgtaggtaagttacttacgtgtcgttcgtccttacgtccttaggttaggtttcgggttcgggtttcggggtcggttcgggggtacgggacgggtacgaacggtcgtacggtacccggtacgtacgtcgaacggccgaacggtccgtccggcccccgttacggtccctaccgttccgtccgttccccgcccttacccgtctacgtcctacgtcg

SEQ ID NO: 374248 - DNA, 652 bp, Homo sapiens
  misc_feature: GZ8MTXP02ILTEF.17.31.C09.1.454.CMB.2.raw
tcagcgtagactagcacgaccggtgctcgatttagacgtctcatcaaggaaggaagggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcaggaggtagaaaaggcccggggagtctctgaggatctctgtaagggttctggatactaggtttcagctactggatcacgtggtgcgccagaacgccggtaaaggcctggagtggagtggggagtagttgatcccgagtcgacttctcacatacaactacccacgtccccgtccttaccgacgccaaccgtccaaccatctcacgctgaactaacgtcatcacgtactcgtccttccgtgaccgtagcggccgcaccggccggtacgggaccggtcccgtacggggaacccacccggtccctaaagttacttaaccgtttacgttcggtacggtccggtacggtttaccccggttaagttcccggaccgacgtaacgactttaccgtaacttaaccgttaaccctaaccggtttacggtaccgttcgggggtaaccgtccggttaaccggggg

SEQ ID NO: 374249 - DNA, 627 bp, Homo sapiens
  misc_feature: GZ8MTXP02FRYYA.17.31.C09.1.454.CMB.2.raw
  modified_base (283)..(283): a, c, t, g, unknown or other
tcagcgtagactagcacgaccggtgctcgatttagacgtctcatcaaggaaggaagggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggatctctgaggatctcctgtaagggttctggatacaggttttccagctactggatcactgggtncgcagaagcccggtaaagcctggagtggagtggggagattgactccgagtgactctcacatacaactaccacgtccccgtccttccgaacggcccacgtccaccatctcagctgacaagtccaatcagtactgtcccttcctgctaggtcggcgcgacgcccgtagggacgtcccgtaccgggaaccacccggcctaatacttaacttaccgtagttcgacggtaacggttccccgggtttaatcccggacccggaccaacggtactaccctaaaccgttaaaccgttaacccgttaaccgttaccgggttccgtacggggtaaccggttcggtaacccggggg

SEQ ID NO: 374250 - DNA, 735 bp, Homo sapiens
  misc_feature: GZ8MTXP02FYP51.17.31.C09.1.454.CMB.2.raw
  modified_base (298)..(298): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaacgcctggccaacgcccccaggacactgatttangatacaaaacaacaaacactccacggacccctcgcccggttctcgagcctccgtcggttcggggacaaacgctcgccccgtcgtcccgtttcgggtcgcgtccgacgccgtgacggagtggaacggctggtaagttagttactcggtctttcgccttcctaccgttaagttagggtttcggggttcggtttccgggggtttggtttccgggggacgggggtaaccgggggaaacccgtaaacgggtccgtttaaccgggtaccccgttaccggttaaacggggttcccgaaaccgggacccccggtaaaacgggtcccgttaccccggtcccccccgggttcggttaccccgtaccctttcccgttaacccggtttccccccgtaaccccctttcccccgttacccgtttaaccgttcccgtttaacccgggtcccg

SEQ ID NO: 374251 - DNA, 634 bp, Homo sapiens
  misc_feature: GZ8MTXP02IKGJG.17.31.C09.1.454.CMB.2.raw
  modified_base (400)..(400): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctcttttctgttcctcctcacttgctgcccagggtccaattcccaggctgtggtgactcaggacgccctcactgactgtcgtccccgaggaggacagtcactctcacctgtggctccagcacgtggacgctgcacaatggtctattactcctactcggttaccaacagagcctggaccaaccgcccccaaggaccacgtgtaatttatacgaactaaccaaaacaaaccaaactacctcctaccggaccctcgcccgttcncacggcctcccgtcggttcgggacaacgctcgtcccgtcgtacccgtttcgggcgtcgacgacgccgtaggaggtacgtaggacggtcgttagtagttacgttacgtgtacgttgtccttcgttaccgttagttacgggttgggttcggtttcggggtcgggtttaccgggacggggtaaggaccgtaacggtcgtacggtacccgtacgtacggttaccgacggtaaccccgg

SEQ ID NO: 374252 - DNA, 587 bp, Homo sapiens
  misc_feature: GZ8MTXP02I24QK.17.31.C09.1.454.CMB.2.raw
  modified_base (349)..(349): a, c, t, g, unknown or other
  modified_base (491)..(491): a, c, t, g, unknown or other
  modified_base (546)..(546): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaggacactgatttatgaataacaaaacaacaaaaccacgtacctcggaccccctggccccggttcncgacggtcctcccgtcggttcgggggaccaaacgcgtcgccccgtacgtccccgtttcggggtgccgtcgacggtccctaggacgggatggaggcctggattaatctgcttgctcgtctatgtggtgttcgggtagttcggnggaggaccgagctgccgtcgtcgcgacgcccgtaggcctcgccccgtcggtaccnctcgtaacgtccccctacctcccgtcctacgtcctacgtcg

SEQ ID NO: 374253 - DNA, 568 bp, Homo sapiens
  misc_feature: GZ8MTXP02GOBAG.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgcccccaaggacactgatttatgataacaaacaaacaaaacactacctggacccctcgcccggttctcacggcctcctccggttcggggacaaagctcgccctcgtcccgttcgggcgcgcagccgtgaggatgagcagagtattactgcttgctctctagttagtggttggttcgggttggttcgggcggacgggaccaaggcgtacgaccgtcgtaggtcacggacccgaggcctcgccccgtcgtcaccgttctccgttccccacccctctaccgtactcgtactcgg

SEQ ID NO: 374254 - DNA, 697 bp, Homo sapiens
  misc_feature: GZ8MTXP02HRANM.17.31.C09.1.454.CMB.2.raw
  modified_base (226)..(226): a, c, t, g, unknown or other
  modified_base (306)..(306): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtgctccagcactgganctgtcacatgtctattactccctatcggttaccaacagaacgcctcggaccaaccgccccccgaggaccactgtatttanagaataaacaaaacaaacaaaacacctcctacggacccctcggtcccgttctccgacggtcctcccgtccggttcggggacctaacggctcgtcccctcgtaccccgtttcgggtcgccgccgacgccgtagacggagtggacggtctaggtagttatttacgtcgtctttcgccttcttaccgttaagttgggttgggtttcggtttcggggtcgggtttccggggacgggacgggaaccgtaaggcgttaccggtacccgttaccgtacgggtaccgaccggacccgtaaacgggtcccgtcccgtacccccggttcgtcccgtaccgttccgttccccgttcccccggtcccgttaccccttccgtttaccgtcccgttacggtccgg

SEQ ID NO: 374255 - DNA, 691 bp, Homo sapiens
  misc_feature: GZ8MTXP02I5KRJ.17.31.C09.1.454.CMB.2.raw
  modified_base (262)..(262): a, c, t, g, unknown or other
  modified_base (358)..(358): a, c, t, g, unknown or other
  modified_base (418)..(418): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtgctcagcactgganctgtacacaatcggtacattactcccctacttcggttacccaaacgtacgaacgcctaggacccaaaccgcccccaaggaccactggtaattttanacgtaactaacaaaacaaaccaaactaccttaccgtcggaccccctggtacccccggttntaccgacggtcctcccggttacgggttcgggggtaacctaaacggtcctcggtaccccgtacggtacccccgtttcggggacgtccggaccgtacgccgtgggaacggtcgtaggaggtcgtaggtacgttacttacgtcgtcgttcgtcgttcctaccgttaacggtaggttcgggttacgggttcgggggttacggttaccggggacggggtaacggggtacccgaaggtccgtaccggtacccgttcgtaacggtccgaacgtaccccgg

SEQ ID NO: 374256 - DNA, 568 bp, Homo sapiens
  misc_feature: GZ8MTXP02JNEMF.17.31.C09.1.454.CMB.2.raw
  modified_base (399)..(399): a, c, t, g, unknown or other
  modified_base (421)..(421): a, c, t, g, unknown or other
  modified_base (506)..(506): a, c, t, g, unknown or other
tcagcgtagactagcacgaccggtgctcgatttagacgtctcatcaaggaaggaagggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatactaggttttccagtctactggatcacctgggtgcgccagaacgccccggtaaaggcctaggagtggagtggggaggattgatcccgagtgactctacacatacaactaccacgtcccgtccttaccaaggccacgtccacatccncagctgacagtccatcagtacngtcctactgcagtgacgtcacgccgtaggcgccgtacgggaccaccgctaatactattaccgtgacgcgtacggtccggttaacnccgggaccacagtactcctaactaacctactacgtacggtcgtcggaccgttcggaccgggg

SEQ ID NO: 374257 - DNA, 544 bp, Homo sapiens
  misc_feature: GZ8MTXP02GMVZ0.17.31.C09.1.454.CMB.2.raw
  modified_base (337)..(337): a, c, t, g, unknown or other
  modified_base (381)..(381): a, c, t, g, unknown or other
  modified_base (472)..(472): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggaggacagtcactctcacctgtggctccagcactggagctgtcaccaagtggtcattactccctactggttccaacagaacgcctggccaacgcccccaggacactgatttancgataacaaaacaacaaacactcctcggacccctgccccgttcncgacgtctcccgtcggttgggggacaaacgctcgccctacgccctttcggggtcgcgcgagcctggacgagtgaggctagacgtatactgntcgtctcgtctatagtgtcggttagggtgttcgggcggaggaccaagctcgacgtcgacggtacacgacccg

SEQ ID NO: 374258 - DNA, 704 bp, Homo sapiens
  misc_feature: GZ8MTXP02HUXJ1.17.31.C09.1.454.CMB.2.raw
  modified_base (225)..(225): a, c, t, g, unknown or other
  modified_base (261)..(261): a, c, t, g, unknown or other
  modified_base (298)..(298): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccgaggagggacagtcactctcacctgtgctcagcactgganctgtcacaatgtctattactccctatcggtaccaanagaacgcctgccaacgccccaggaccactgtatttangaataaacaaaacaaacaaactacctccgaccggtacccctcggtcccgttctacgacggtcctccccgtcggggttacggggacaacgccgtcgtccccgtacggtcccccggtttgggcgccgtccgacgccgtaggacgggtatggtacggtacttagggtaactttactttaccgttgttccgttcgtacccttcttacgttaaggttcgggtttgggtttcggggtttcggggtttcggggttcgggggaccgggtaacgggaacccgtaacggtccgtccgggtaacccgtccgtaacggtccaccggtcccgaacgggtcccctccggtcccccgtccggtactcccgttcgttcccgttcccccgcccctttccctaccgttacctccgtacgtccgg

SEQ ID NO: 374259 - DNA, 813 bp, Homo sapiens
  misc_feature: GZ8MTXP02HVO2D.17.31.C09.1.454.CMB.2.raw
  modified_base (325)..(325): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtcgtccccagggagggacagtcactctcacctgtggcctccagcactggagctgtacaccaagtcggtctatttactcccttaacttcggttaccaaacgagaacgccgtacggaccaaaccgccccccgaggaccactgtatttanagtaaactaaacaaaacaaaccaaaacctaccgtacctaccggtaccccgtcggtacccggtttcctccgacggtcccgtccccgttcgggtttaccgggggaccaaacggtccgttacgtccccgttcggttacccccgggtttcggggtcgtcccgtaccggaccggtcccgtaggggtaacgggacgtagggaacgggttcgtaggttagtttaacgtttacggtcggttctttcggccttcctaccgttagttcgggtttggtttcgggggtttcggggttacgggtttacggggaccgggggtaacgtaacccggtaaggtccgttaccgtcccggttaccgggttacggaccgtaacccgcccggtaaagggtccccgtccccggttcccccgttaccggggttccctaacccggtttcctaacccccggttttcccccgaccccttttcccctaaccgtttccgtacccgtccggttccgg

SEQ ID NO: 374260 - DNA, 631 bp, Homo sapiens
  misc_feature: GZ8MTXP02IV9U2.17.31.C09.1.454.CMB.2.raw
  modified_base (227)..(227): a, c, t, g, unknown or other
  modified_base (274)..(274): a, c, t, g, unknown or other
  modified_base (312)..(312): a, c, t, g, unknown or other
  modified_base (403)..(403): a, c, t, g, unknown or other
tcagcgtagactagcacgaccggtgctcgatttagacgtctcatcaaggaaggaaggggaccaggggtcccttccaatatcagcaccatggcctggactcctctcttttctgttcctcctcacttgctgcccagggtccaattcccaggctgtggtgactcaggagccctcactgactgtcgtccccaggaggacagtcactctcacctgtggctccagcactgganctgtcaacctaagtgtactattactcctacgtcgtaccaacgagacnccgtcgaccaaccgccccgaggaccactagtactttanagtaactaaacaaacaaaccaaaaccaccttaccgccgtacccctcgtaccccgttcacgacgtcccgtcctccggggtcggacaacgtcnccgtcgccgttccgttcgggcgtcgcgacgtccgtaggacgtgaggacgtgtagtacttctagtcgtcgttcgtactcttacgtagttcggttggttcggttggtcggttcgggacgggtacgacgacgtcgacggtccgtacgtcgacaccgacgacgtcgtccccgtcccgtacgtactacccgtcgtcccctacccgtccctcccttacgtcccgtacaccgtcg

SEQ ID NO: 374261 - DNA, 623 bp, Homo sapiens
  misc_feature: GZ8MTXP02F06H3.17.31.C09.1.454.CMB.2.raw
  modified_base (403)..(403): a, c, t, g, unknown or other
  modified_base (533)..(533): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagcccctcactgactgtcgtccccagggagggacagtcactctcacctgtggctccagcactggagctgtcaccaatggtcattactccctactcggttaccaacagaacgccgtcggacccaacgcccccaggaccacgtgtatttatacgaactaacaaaacaaacaaacacctccgtccggacccctgccccggttaccncgtacggcccttcccgtcgggttcgggggaccaaaggtcctacggccccgttcggtacccccgttttcggggcgtccgacgacgtcccgtagggacggtagttggacgggcgttagtacgttatttacgngttcttcgcttctcctagtggttggtcggttcgggttcggttcgggcgggtaaggccaaggcgtcggaccgtcgacggtcacgtacccgg

SEQ ID NO: 374262 - DNA, 606 bp, Homo sapiens
  misc_feature: GZ8MTXP02FJAED.17.31.C09.1.454.CMB.2.raw
  modified_base (361)..(361): a, c, t, g, unknown or other
  modified_base (407)..(407): a, c, t, g, unknown or other
  modified_base (409)..(409): a, c, t, g, unknown or other
  modified_base (474)..(474): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctcttctgttcctcctcacttgctgcccagggtccaattccccaggctgtggtgactcagagccctcactgactgtcgtccccaggagggacagtcactctcacctgtcggctccagcactggagctgtccaccaatcggtcattatcccctaactcggttacccaaacagtaacgccctcgggaccccaaccgcccccccaagggaccaccgtgtatttangactaaccaaacaaccaacacctcctcggacccctcggcccgttcncncgcctccgtcggtcggggacaacgcgtcgcccgtcgtacccggttcggcgcgcgcgccgtggagntggacgtcgtagtacgttacttacgtcgtctgtcctactacgtagtaggtggttcggttcggggtacggtccgggacgggaccggaccgtaacgtcgtaccggtaccgtaccgtacggtaccgaccgacccg

SEQ ID NO: 374263 - DNA, 572 bp, Homo sapiens
  misc_feature: GZ8MTXP02F0IV8.17.31.C09.1.454.CMB.2.raw
  modified_base (257)..(257): a, c, t, g, unknown or other
  modified_base (261)..(261): a, c, t, g, unknown or other
  modified_base (263)..(263): a, c, t, g, unknown or other
  modified_base (310)..(310): a, c, t, g, unknown or other
  modified_base (327)..(327): a, c, t, g, unknown or other
  modified_base (337)..(337): a, c, t, g, unknown or other
  modified_base (408)..(408): a, c, t, g, unknown or other
  modified_base (416)..(416): a, c, t, g, unknown or other
  modified_base (527)..(527): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatgtcattatccctatgtccanagancnggccaagcccccaggacactgattatgatacaaacaacaacactccncgacccctgcccgttcncgagcctccncggttggggacaagctcgccctgtcccgtttgggcgtcgcagcctgacgatgaggctagtagttattacgngtcgttcnctcctctagttcggtggttcggttcgggtagttcggggacgtacgggaccaaggtcgtacgccgttacgtaggtcacgaccccaggccgttccgcccccgtcggttacccnccgttccgtccgtccccgtaccctccctacgtacgtccgtacgcg

SEQ ID NO: 374264 - DNA, 749 bp, Homo sapiens
  misc_feature: GZ8MTXP02I76AN.17.31.C09.1.454.CMB.2.raw
  modified_base (356)..(356): a, c, t, g, unknown or other
  modified_base (385)..(385): a, c, t, g, unknown or other
  modified_base (454)..(454): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtcgtccccgaggagggacagtcactctcacctgtgctccagcacgtggagctgtacaacctaagtcggtactattactacccttacgttcggttaccaaacaggaaacgccgtcggacccaaccgcccccgaaggtaccacgtgtaatttatagaactaaacaaaacaaacaaaaccnctacctaccggacccctcgtccccgttcncgacgcctccgtccggtggggacaagcctgaccctgtacccgtttgggcgcgccagccgtaggaacggngtacgaggctggtaacgttacttagttcgtccttgtacccttcgttccttaaaggttcgggtttacggggttcgggttttcgggggtcggggtttacccggggaacggggtaacgggaaacccgtacgggtccgtaccgggtaacccggtccgttaacggggtaccgaccggtaaccccgaggtccccgttacccggtaccccggttccggtaacctcccgtttacccggttcccctttaccccccggtaacccctttccccggttcctttacccggtaccttaaccggtccggg

SEQ ID NO: 374265 - DNA, 595 bp, Homo sapiens
  misc_feature: GZ8MTXP02IEU23.17.31.C09.1.454.CMB.2.raw
  modified_base (352)..(352): a, c, t, g, unknown or other
  modified_base (399)..(399): a, c, t, g, unknown or other
  modified_base (496)..(496): a, c, t, g, unknown or other
tcagcgtagactagcacgaccggtgctcgatttagacgtctcatcaaggaaggaaggggagataaagagccatcagaatccagccccagctctggcaccaggggtccccttccaatatcagcaccatggcctggactcctctctttctgttcctcctcacttgctgcccagggtccaattcccaggctgtggtgactcaggacgccctcactgactgtcgtccccaggagggacagtcactctcacctgtggctccagcactggagctgtcaccaatggtacattactccctactcggttaccaacagaacgcctcgggaccaacgccccccaaggaccacgtgtaatttancgaataacaaacaaacaaacacctcctcggaccccctgcccgttacnccgacggcctcccgtcggttggggaccaaacgcgtcgccctcgtacccgtttgggcgccacgacgccgtggacgagtggaggcgtagacgtaattcnggtcttgcctctacctaagtcggttggttcggtttcggggtaggttccgggcgggtacggaccgaaggtcgtacgtaccgtcgtacggacacgaacccg

SEQ ID NO: 374266 - DNA, 685 bp, Homo sapiens
  misc_feature: GZ8MTXP02GN50J.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccgaggagggacagtcactctcacctgtcggctccagcacgtggacgctgtccaacctagtcggtctattacctccccttacgtcgggtttaccaaacgacgtaacgcccgtaggacccaaaccggcccccgaaggaccacgtgatttagagaactaaaccaaaacaaacaaaccaccttccgtaccggacccctcggtaccccggttcctcgacgggtcccttaccccgtcggggttcggggaaccaacgcgtaccgccccgttacggtccccgtttcgggcgtcgcgaccggtccgtagggacggtagtcggaaggtcgtagtagttagttacgtcgtcgttcggtaccttcgttaccgttaagtcgggtttgggttccggggtttacggggttcgggttccgggacggggaacgggttacccgaaggtcgtacggtacccgtcggtacgtcgacgacccgg

SEQ ID NO: 374267 - DNA, 710 bp, Homo sapiens
  misc_feature: GZ8MTXP02HZRAZ.17.31.C09.1.454.CMB.2.raw
  modified_base (362)..(362): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcgaggacgccctcactgactgtcgtcccgaggaggacagtcactctcactgtgctcagcactggacgctgtccaaccaagtcggtactaattactcccctattcggttacccaacgtagaacgccgtaggaccccaaccggcccccaggaccacgttagaatttanacgaactaaaccaaacaaacctaaactaccctacccgtaccgggacccccttacggtacccccggtttcctaccgacggtacccttccccggttacggggttacgggggaccctaaaggtccgtaccgtccccgttacggtacccccgtttgggtcgaccgtcgacggtacccgtggaaggtcgtagggtaccggatacggtaagttaacgtacgttcgtcttacggtcctacgttacccttaaagttcgttaggtacgtttcggggtttcgggttcgggttaccgggacgggtaacggaaccgaacggtccgtacggtaacccgtccgtacgggttacccaacccgg

SEQ ID NO: 374268 - DNA, 535 bp, Homo sapiens
  misc_feature: GZ8MTXP02GCUDA.17.31.C09.1.454.CMB.2.raw
  modified_base (297)..(297): a, c, t, g, unknown or other
  modified_base (299)..(299): a, c, t, g, unknown or other
  modified_base (301)..(301): a, c, t, g, unknown or other
  modified_base (335)..(335): a, c, t, g, unknown or other
  modified_base (338)..(338): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttanananaacaaacaacaacactctcgaccctcgtccgtcncgngcctccgtcggtgggacaacgctcgcctcgtccgttcgggcgcgcagcgtgagagtgagctagtatatactgtctcgtctctactagtgtggttggttcgggtgtcgggacggacggacagcgtcgacgtagagtacgcacgaccgacgccgtccgcccgtcgtctctcgtccgtcccgtcctctccgtacgtctcg

SEQ ID NO: 374269 - DNA, 622 bp, Homo sapiens
  misc_feature: GZ8MTXP02IBZ3Y.17.31.C09.1.454.CMB.2.raw
  modified_base (457)..(457): a, c, t, g, unknown or other
  modified_base (554)..(554): a, c, t, g, unknown or other
tcagcgtagactagcacgaccggtgctcgatttagacgtctcatcaaggaaggaagggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaaagcccggggagtctctgaggatctcctgtaaggttctggatactaggttttccagtctacgtggactcaccgtgggtcgccgccaaggaacgcccggtaaaggcctaggagtggagtggggagtatgactccgagtcgactctcacatcaactaccacgtcccgtcctacgaacggccacgtccacatcctcagctagacaacgtccaatcaacgttactcgtcccttcgtcgcgaggtcggccncgacgccgtgggacgcccgtacgggaccaccgacctaagtaacttacgttaccgtggtacgtaccggtacggtttacccggtttagcccgcccgganaacgtactacctaaaccgttaacttaacccgaccgttacggtccgtacggaccgttcggtacccgggg

SEQ ID NO: 374270 - DNA, 594 bp, Homo sapiens
  misc_feature: GZ8MTXP02I3KY8.17.31.C09.1.454.CMB.2.raw
  modified_base (400)..(400): a, c, t, g, unknown or other
  modified_base (406)..(406): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactcggttccaaacagaaagcctggccaacgccccccaggaccactgaatttatgataacaaacaaacaaaacactcctacggaccccctgcccgttctcgacgcctcctcggtggggacaaagctcgccctgcccgttgggtcgcgcngtccgngacgagtgagcgtagagttattacgtgcttgcctctcctatagttggtggttcggtcgttcgggacggacggacgaagtcgtacgtaccgtcgtacggtcacgaccgaacggccgtaccggccccgtcggtacctccttaccgtccgttaccccctacccgtcccttaccgtaccgtctacgtcccgg

SEQ ID NO: 374271 - DNA, 696 bp, Homo sapiens
  misc_feature: GZ8MTXP02GB2N7.17.31.C09.1.454.CMB.2.raw
  modified_base (549)..(549): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcgaggacgcccctcactgactgtcgtccccgaggagggacagtcactctcacctggtcgctccagcacgtggacgctcgtaccacctaagtcggtactactttacctccccttacgtacgggttacccaaacgagaacgtcccgtacggacccaacccgtcccccgaggtacctacgtagtaatttacacgaactaaaccaaaacaaaccaaactccctaccgtccggtaccccctcggtaccccggttcaccgacggtcccttacccggttcggggttacgggggaacctaaacgccgtaccgtcccgttacggtacccggtttcgggcgtccgccgacggccgtggacggngtggacggtacgtagtagttacttacgtgtcgttcgtcctcgttaccgttaaggtcggttggggtttcgggttcggggttcggggttccgggacggggtacggtacgtaacgtcgtaccggtaccgtacggtacgcgacccgaccgg

SEQ ID NO: 374272 - DNA, 663 bp, Homo sapiens
  misc_feature: GZ8MTXP02JAFI1.17.31.C09.1.454.CMB.2.raw
  modified_base (227)..(227): a, c, t, g, unknown or other
  modified_base (299)..(299): a, c, t, g, unknown or other
  modified_base (339)..(339): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccagggagggacagtcactctcacctgtggctccagcactgganctgtcacaatggtcattactcctactggttccaacagaagcctggccaacgcccccaggacactgtatttangataacaaacaacaaacacctctcgaccctcgcccgttcncacgctccgtcggtcggggacaaacgctacgcccgttcgtccccggtttcgggtcggccgcgacgtccgtggacggtagtaggaggtcgtaggtaggttacttactcgtactttcgccttccttccgttaagttggttgggtttcggtttcggggtcggtttcggggacgggtacggggaccgtaaggccgttacggacccgttaccgtaggtaccgaccgacccggaaacggtcccgtacccgtcccccgtccgtaccgtccgttccgttccgttccccccgtacccgttcccgttacccttacggttacccgtacgtcccgg

SEQ ID NO: 374273 - DNA, 667 bp, Homo sapiens
  misc_feature: GZ8MTXP02GFAO7.17.31.C09.1.454.CMB.2.raw
  modified_base (226)..(226): a, c, t, g, unknown or other
  modified_base (302)..(302): a, c, t, g, unknown or other
  modified_base (417)..(417): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccaggtccaattcccaggctgtggtgactcaggagccctcactgactgtgtccccagggagggacagtcactctcacctgtggctccagcactgganctgtcaccaatggtcattactccctatcggttaccaacagaacgcctggccaacgcccccaggaccactgatttanagataacaaacaacaaacactcctacgacccctgcccgttctcgacgcctccgtcggtcggggacaaagtctcgccctcgtcccgtttcgggcgtcgcgacgccgtggaggacgnggagcgtagagttagttacgtgtacgttcgtcttaccttcgttaacgttggtttcggggttagggtttcggggtgggttaccggggacgggtaacgggaaccgtaggtcggtaccggtacccggttaccgtacggtaccgaaccggtacccggtaaacggtcccggtacccgtaccccccggttcggtcccgtacccgttccgtcccgttccccgtacccttcccttccgttacgtacccgtacgtccgg

SEQ ID NO: 374274 - DNA, 575 bp, Homo sapiens
  misc_feature: GZ8MTXP02FWC7D.17.31.C09.1.454.CMB.2.raw
  modified_base (300)..(300): a, c, t, g, unknown or other
  modified_base (402)..(402): a, c, t, g, unknown or other
  modified_base (406)..(406): a, c, t, g, unknown or other
  modified_base (433)..(433): a, c, t, g, unknown or other
  modified_base (533)..(533): a, c, t, g, unknown or other
  modified_base (548)..(548): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaacgcccccaggacactgtatttangataacaaaacaacaaaaccactaccgtcgaccccctgtcccggttctccacggtcctccgtccgggttcggggacaaacgctcgccctgtcccgttgggcncgcngcctgagatgagtctgagttattacgngtcttgctctctagttacgtggttgttcgggtgttcggggagtacggacaggactcgaccgtcgtggtcacggaccaaggcctccgtccccgtcgtaccnctccgtcgttccccnccgttccctccgtacgtccctacgtcg

SEQ ID NO: 374275 - DNA, 719 bp, Homo sapiens
  misc_feature: GZ8MTXP02JKING.17.31.C09.1.454.CMB.2.raw
  modified_base (373)..(373): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccgaggagggacagtcactctcacctgtcggctcagcactggagctgtccaacctaagtcggtactattacctccccttatcgggttacccaaacgtacgaacgtccgtacggacccaaaccgccccccgaaggaccaacgtagtaatttanacgtaactaaacaaaaccaaaacaaaccacctacccgtaccggggtaaccccctggtacccccggttactacccggtaacgggtcccttccccggttacggggtacgggggtaaccaaaccggtccttaccggtccccgttacggttacccccggtttcgggggtcgaccggccgacggtaccgtagggacgtacggtacggaagggtcgtaggtaagttacttacgtcggtcttcggtctcgttaccttaagttcgggttgggttcgggttcgggttcgggttccgggacggggaaccggaccaaggtcctacggtacccggtcgtaacgtccgacgaacccggg

SEQ ID NO: 374276 - DNA, 659 bp, Homo sapiens
  misc_feature: GZ8MTXP02JGY6P.17.31.C09.1.454.CMB.2.raw
  modified_base (264)..(264): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcacgtgganctgtcacctaatggtacattactccctactcggtttaccaacacgaagtccgtacggacccaacggccccccgaaggaccactcgtaatttatacgaactaaacaaaacaaacgaaacacctcctcgggacccctacggtccccggttctacgacgtcccgtcccgttcgggtacggggacaaacgtctacgccctcgtacccgttcgggtgcgcgagtcccgtgacggtatggaggtaccgtagggaacttagttaacgttcgtcggttctccgttcttcccgttaagttaggttcgggttcgggtttacggggttcggttccgggtacggggaaccggtaaccgaacggttcgtaccggtaccgtaccgtaacggttcgaccggtaaccccgg

SEQ ID NO: 374277 - DNA, 749 bp, Homo sapiens
  misc_feature: GZ8MTXP02G16FL.17.31.C09.1.454.CMB.2.raw
  modified_base (223)..(223): a, c, t, g, unknown or other
  modified_base (297)..(297): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtcccaggagggacagtcactctcacctgtgctcagcactgganctgtcaccaatggtcattatccctatcggttaccaacagaacgcctggaccaacgcccccagacactgatttangaatacaaaacaacaaaacactacctacggacccctcggcccggttctacgacggtcctccgtccggtacggggacaaacggctcgacccgtcgtccccgtttcgggtcgccgccgacgtccgtaggaggtagttacggaacggtgtaggaacgtttacgtttaacgttcggtcgtttcggaccgtttccttacccgtttaaagtttaggggtttcgggggtttcgggtttttacgggggttcgggttttcggggggaaccggggaacgggtaaccgtaacggtaccggttaccggaaccccggtttacgggtaaccgggttccggaacccgtaacccggttaaacggggccccgttacccggttccccccgtcggggttaccctacccggttccgttcccgggttccccctaccccggttcccttcccgtaacgtcccgttaacgtcccgg

SEQ ID NO: 374278 - DNA, 635 bp, Homo sapiens
  misc_feature: GZ8MTXP02G2BFA.17.31.C09.1.454.CMB.2.raw
  modified_base (300)..(300): a, c, t, g, unknown or other
  modified_base (319)..(319): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaacgcccccaggacactgtatttangataacaaacaacaaaacnctcctgacccctgcccggttctcacgcctcctccggttcggggcaaagctcgccctcgtcccgttcgggtgccgccacgccgtggacggtagtgacggtcgtgaagttatacgtgtcttcgtctcttcctaagttcggttgggttggtttcggggtggtttccgggggacgggtacggggtaccgaaggtccgtacggacccgttaccgtagggttccacgggtacccgaaacggtccgtccggacccccgttcggtccctacgttcccgttaacgttcccccacctttcccggtacctacgtttcccgacgtccg

SEQ ID NO: 374279 - DNA, 830 bp, Homo sapiens
  misc_feature: GZ8MTXP02I8CP3.17.31.C09.1.454.CMB.2.raw
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcgaggacgccctcactgactgtcgtcccgaggaggacagtcactctcactgtcgctcagcacgtggacgctgtaccacctaagtcggtactacgtttacctccccgttacgtacgggttacccaaacgtaaggaaccggtcccgtacgggaccccgaaaacccggtccccccgaaagggtaaccctaacgttaggtaaactttttaacgtacggtaaaaccttaaaaccgaaaaacctaaaaccgtaaaaccctaaccccgtttaccccggtacccggggtaacccccccgttacggggttacccccccggggtttacctacccgggtaaaccggggtccccctttaccccgggttacgggggttaccgggggaaccctaaaccggtccgttacccggtaccccgttcgttaccccggtttcggggtacgtccgacgtacggccgtaggacggtacgttgtacgttacggttagtaacgttacgttaccgtagtcgttcgtaccttcgttaccgttaggttagggtttcggttcgggtttacggggttcgggttacggggaccgggtacgggtaacccgtaacgggtcgtaacgggtaccccgttacggtaccggtaccgtaccggtaacccgg

SEQ ID NO: 374280 - DNA, 611 bp, Homo sapiens
  misc_feature: GZ8MTXP02HXZLT.17.31.C09.1.454.CMB.2.raw
  modified_base (204)..(204): a, c, t, g, unknown or other
  modified_base (348)..(348): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcagggacnccctcactgactgtcgtccccaggacggacagtcactctcacctgtcgcctccagcactggagctgtcacaatggtacattactccctatcggttaccaactagaacgcctaggaccaaccgccccaggaccacgtgtatttanacgtaataaccaaaactaaacaaactaccttaccgtacgaccctcgtccccgttctccgacgtccttacccgtcggtacggggaactaacgctcgcccgttcgtacccggtttcgggcgccgcgacgaccgtgaaggtactggacgtacgtagtaagtacttacgtcgtctcgcttctacgtagtggttggttcgttcgggtcgttcgggacggtacggacgaacggtctaacggtaccgtacgtaccggtacgaacgcccgg

SEQ ID NO: 374281 - DNA, 587 bp, Homo sapiens
  misc_feature: GZ8MTXP02JKM97.17.31.C09.1.454.CMB.2.raw
  modified_base (351)..(351): a, c, t, g, unknown or other
  modified_base (400)..(400): a, c, t, g, unknown or other
  modified_base (445)..(445): a, c, t, g, unknown or other
  modified_base (490)..(490): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcacgtggagctgtcaccaatcggtcattactccctactcggttaccaacgagaagcccgtaggaccccaacgcccccgaggaccacttgatttanacgtataaacaaacaacaaacactaccctcgacccctggacccccgttncgacgctcccgtggtcggacagctcgcctcgacccgttcgggtcncgcgagtccgtgaggatcgagcgtagacgtacttacgtgtcgttncctctccgttaagtcggttggttcggttcggggtcggttccgggacggtacgggacgaacgtcgtacggtccggtagtaccggtacgacgtacccgg

SEQ ID NO: 374282 - DNA, 587 bp, Homo sapiens
  misc_feature: GZ8MTXP02GWBVY.17.31.C09.1.454.CMB.2.raw
  modified_base (224)..(224): a, c, t, g, unknown or other
  modified_base (459)..(459): a, c, t, g, unknown or other
  modified_base (462)..(462): a, c, t, g, unknown or other
  modified_base (468)..(469): a, c, t, g, unknown or other
  modified_base (506)..(506): a, c, t, g, unknown or other
  modified_base (524)..(524): a, c, t, g, unknown or other
tcagcgtagactagcacgaccggtgctcgatttagacgtctcatcaaggaaggaagggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaacggccgggatcnctgaggatctcgtgtaaggttctggatacgtaggttttccagtctacgtggactcgacgtgggtgccgacgagaaccggtacccggtaaaggccgtaggaggtggaggtaggggagtagtgactccgagtcgactctacactatacaactaccgaccgtcccctcctaccgaacgccctacgtccaccatcctacgcgtctacgactaacgtaccatacacgtactcgtcctcgncgngtcgcnncgcgtggcgtccacggaccaccgactatatactacgngacgcgtacgtaccgttnccggcacgacgctaccacgttaactaacgtacgttacgtccgtacggtaccgtcgggaccggg

SEQ ID NO: 374283 - DNA, 632 bp, Homo sapiens
  misc_feature: GZ8MTXP02G537W.17.31.C09.1.454.CMB.2.raw
  modified_base (436)..(436): a, c, t, g, unknown or other
  modified_base (531)..(531): a, c, t, g, unknown or other
  modified_base (549)..(549): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcgaggagccctcactgactgtcgtccccgaggagggacagtcactctcacctgtcggctccagcacgtggagctgcaccaatggtcattactcccctactggtttaccccaaacacggaaacgcccgtagggaccccaaacccggccccccgaagggacccaacgttcgaatttttagacgtaactaaacaaaacaaacaaacctaccgtacctccgggaccccctggcccccggtttcnccgacggtccctacccgttcgggttgggggaaccaaagtccgtcgccccgttcgtaccccgtttgggtcgccgtcgacgccgtgacggtataggnggactagagttattacgngtcttcgctctactagtcgttggtcggttcggtgttccgggcggtacggaacaagtcgtacggaccgtcgacggtcacgaccg

SEQ ID NO: 374284 - DNA, 611 bp, Homo sapiens
  misc_feature: GZ8MTXP02JPCNV.17.31.C09.1.454.CMB.2.raw
  modified_base (202)..(202): a, c, t, g, unknown or other
  modified_base (225)..(225): a, c, t, g, unknown or other
  modified_base (296)..(296): a, c, t, g, unknown or other
  modified_base (338)..(338): a, c, t, g, unknown or other
  modified_base (390)..(390): a, c, t, g, unknown or other
  modified_base (404)..(404): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccaggtccaattcccaggctgtggtgactcaggagccctcactgactgtgtccccaggagggacagtcactcncacctgtggctccagcactgganctgtcaccaatggtcattatcctactggttccaacagaagcctggccaacgcccccaggacactgatttangataacaaacaaacaaacacctcctcgaccctcgcccgttcncgacgctccgtcggtggggccaaagtctacgcccgtgtccccggtttgggcncgtcgcgccgtagnggagtgaggctaggattacgtactgactttcgctcttccgtaagtggttggttcggttcggggtgttcgggacggtaggaccgaaggtcgtacggaccgttcgtacgtaccaccggtaccgaacggtcctacccggtccccgtccgtcccgtaccgttccgtccgttccccccgaccttcccgtcccgttacgtcccgtaccgtcgg

SEQ ID NO: 374285 - DNA, 758 bp, Homo sapiens
  misc_feature: GZ8MTXP02FZE03.17.31.C09.1.454.CMB.2.raw
  modified_base (293)..(293): a, c, t, g, unknown or other
  modified_base (302)..(302): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctatcggttaccaacagacgcctcggccaacgcccccaggaccntgtatttanagtataaacaaacaaacaaacacctccgtacggacccctcgtcccggttcaccgacggtcctccgtcggttcggggacaaacgcctcgtccccgttcgtcccgttttcgggcgaccgtccgacgccgtagggacggtagtggacggtctaggtacgtttacgttactcggttcgttcgtccttaccttaccgttaaggttgggttgggtttcggggtttcgggggttcgggtttaccgggggaccggggttaaccgggaaccgtaacggtccgttacgggaccccggttaccggtaacggttccgaaccggtaccccgtaaacggggtccccgttcccggtccccccggtttaccgggtaccccttaccccgtttccccggttccccggtttccccccgtaaccccctttcccccggttaacccgtttaccggttcccgttaacccggttcccggg

SEQ ID NO: 374286 - DNA, 693 bp, Homo sapiens
  misc_feature: GZ8MTXP02IIUAW.17.31.C09.1.454.CMB.2.raw
  modified_base (311)..(311): a, c, t, g, unknown or other
  modified_base (417)..(417): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaagtcgtctattactccctactcggttaccaacagaacgcctaggaccaacgccccccaggaaccactagtatttanagataacaaaacaaacaaaaccactaccgtcggaccccctcgtccccgttctccgacggcctccgtcggttcggggaccaaagctcgcccgtcgtcccgttcgggngccgcgacgccgtagaggtagtggacggtctaggtacgttagttacgtgtcttcgtccttacgttccgttaaagtggttggggtttcgggtttccggggttgggtttccgggggacggggaacggggaaccgaacggtccgtacggtacccgttacgtaacgggtccgaaccggtcccggaaacggtcccgtcccggtccccccgttcgggtaccctcccgttccgtcccgttcccccgtccccgttccctcccgttacggtacccgtacgtccgg

SEQ ID NO: 374287 - DNA, 562 bp, Homo sapiens
  misc_feature: GZ8MTXP02GXOB7.17.31.C09.1.454.CMB.2.raw
  modified_base (302)..(302): a, c, t, g, unknown or other
  modified_base (347)..(347): a, c, t, g, unknown or other
  modified_base (389)..(389): a, c, t, g, unknown or other
  modified_base (409)..(409): a, c, t, g, unknown or other
tcagcgtagactagcacgaccggtgctcgatttagacgtctcatcaaggaaggaaggggaccagggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttaccaactagaagcctgccaacgcccccaggaccactgatttanagaactaacaaacaacaaacactaccgtacgaccctcgtccgtcncgacgtctccgtcggtggacacgctcgcctcgtccgttggcncgcgcgcgagagagtgacgngtagtagtatatgtctctctctctagtgtgtggttggtggtcggcggacgacgacgcgtacgacgtacgtacgtacgacgacgacgcgtccgtcccgtccgtccgtaccttccgtccgttcccgtcccgtcctaccgtacgtaccgtacgtcg

SEQ ID NO: 374288 - DNA, 651 bp, Homo sapiens
  misc_feature: GZ8MTXP02IU1GP.17.31.C09.1.454.CMB.2.raw
  modified_base (308)..(308): a, c, t, g, unknown or other
  modified_base (350)..(350): a, c, t, g, unknown or other
  modified_base (420)..(420): a, c, t, g, unknown or other
  modified_base (635)..(635): a, c, t, g, unknown or other
tcagcgtagactagcacgaccggtgctcgatttagacgtctcatcaaggaaggaagggggagataaagagccatcagaatccagccccagctctggcaccaggggtcccttccaatatcagcaccatggcctggactcctctctttctgttcctcctcacttgctgcccagggtccaattcccaggctggtggtgactcgaggacgccctcactgactgtcgtccccgagggagggacagtcactctcactgtggcctcagcacgtggagctgtccacaagtggtcattactccctatggttaccaanagaacgccgtggccaaccgcccccaaggccactgtaatttanacgtaactaaaccgaaaacaaaccaaaactaccctaccctccgggtaccccctcggtccccggtttaccnccgaacgggtcccgttaccccggttcgggggttacgggggaacccaaacgggtccgaccggtccccgttacggtcccccggtttgggggtccgccgacgacggtccgtagggacggtagtgggacgtcgtagtagttattacgtgtctgtctctacttaggtagtgggttcggttgggtcggtcgggcggacggacaagtcgtacggcgttacgngtaccgacgtacccgg

SEQ ID NO: 374289 - DNA, 754 bp, Homo sapiens
  misc_feature: GZ8MTXP02GOC29.17.31.C09.1.454.CMB.2.raw
  modified_base (244)..(244): a, c, t, g, unknown or other
  modified_base (251)..(251): a, c, t, g, unknown or other
  modified_base (253)..(253): a, c, t, g, unknown or other
  modified_base (264)..(264): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggagccctcactgactgtcgtccccgaggagggacagtcactctcnctgcgcncngcacgtggacnctgtacacagtcgactatctcctacgtcgtaccaacgtagacgtccgtacgaccaccgaccccgaggacctacgtagtatttacgacgtaaactaaaccaaaacaaaacctaaacctaccgtaccgtacccgggtaccccgtaccgggttacccggttacctaccggaccggttcccgttccccgggtttacgggggttacgggggaaacctaacggtccgttaccggccccgttacggttaccccggtttgggggacctccggaccgtcggaccgttaggacgggtacgttcggggacgttacgtagtaacggtttacttacggttcggtctttcggtacctttccggttaactttaacggttggggttcgggtttcgggggtttccgggggttacgggttccgggggaacggggaaaccggggtacctaacgggttcggtaacccggttcccggtaacgttcggggtaacccgacccggtaacccggg

SEQ ID NO: 374290 - DNA, 674 bp, Homo sapiens
  misc_feature: GZ8MTXP02GXDQX.17.31.C09.1.454.CMB.2.raw
  modified_base (476)..(476): a, c, t, g, unknown or other
  modified_base (490)..(490): a, c, t, g, unknown or other
tcagcgtagactagcacgaccggtgctcgatttagacgtctcatcaaggaaggaagggggagtctccttcaccacccagctgggatctcagggcttccttttctgtcctcctccaggatggggtcaaccgccatcctcaccctcctcctggctgttctccaaggagtctgtgccgaagtgcagctggtgcagtccggagcagaggtagaaaacggcccggggatctctgaggatctctgtaaggttctggatactggtttccagctatggtatcaccgtgggtcgcgaccgaggaacgacccggtaaaggccgtagggagtggaggtggggaggtattgactccgagtcgactctcaactactaccgtaactaccccgaccgtcccccgttaccttacccgaacggcccaacgtccaccacttcctacacggtctacgacctaaacgttccaatctaacgtactcgtcccttaccngccgtaggtcgccncgtacggtccgtagggaccggccccgtacgggaaccctacccgtccaagttacttactttacgcgggtcgtaccggtacggtttacccggttaatccggacccgtatacgtaccttacctaaacttaacccttacggttaaacgtccggttacggtacggtaacccgtcggggtaaccccgggg

SEQ ID NO: 374291 - DNA, 696 bp, Homo sapiens
  misc_feature: GZ8MTXP02II3US.17.31.C09.1.454.CMB.2.raw
  modified_base (225)..(225): a, c, t, g, unknown or other
  modified_base (297)..(297): a, c, t, g, unknown or other
  modified_base (439)..(439): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtcgtccccagggaggacagtcactctcactgtgctcagcacgtgganctgtcaaccaatggtctattactccctacgtcgttaccaacagacgccgtgaccaacgcccccgaggaaccnctgtatttatgaactaacaaaacaaacaaactactaccgtcgtaccccgtcgtcccgttcgtccggcttcccgtcggtcggggacaacggtctacgcccgttcgtacccgtttcgggccgtcgcgtacgccgtggaggtagngaggtacgtgtagttacttacgtcgtcctttcgactttccgtaccgttaagttcggggtttcggtcgggtttcgggggttcgttaccggggacgggggtaaccgggtaccgaacgtcggtacgtacccggtacgtaccgggtcaccggtaaccggacggtcccgtcccggcccgaaaccggtttccaccgttcccgtcccgtttaacccccgccccctttcccgtacccgttagtccccgttacggtccggtccggg

SEQ ID NO: 374292 - DNA, 648 bp, Homo sapiens
  misc_feature: GZ8MTXP02I8LIJ.17.31.C09.1.454.CMB.2.raw
  modified_base (448)..(448): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggacgccctcactgactgtcgtccccgagggagggacagtcactctcacctgtcgctccagcacgtggagctgtcaccaatgtactattactccctactcggttaccaaacagaacgcctggcccaacgccccccgaaggaccactacgtaagtttatgtaaactaaacaaaacaaaccaaaaccacctaccgtaccggaaccccctcggtccccggtttcaccgacggccttccgtcggttacggggaccaaaggcctcgcccttcgtcccgtttcgggctccggnacggcctaggacggtatggaggctaggtagttagttacgtgtcttcgcttcttacctaagttggttcgggttggttcgggttacggtcggggtacgggacggaccaaggtccgtagacccgtcgtagcgacgtaccgagccgtcgaccccgtcgacctccttcgtccgttcccacccttccaccgtcgtccgcgtaccgg

SEQ ID NO: 374293 - DNA, 649 bp, Homo sapiens
  misc_feature: GZ8MTXP02IG7RQ.17.31.C09.1.454.CMB.2.raw
  modified_base (303)..(303): a, c, t, g, unknown or other
  modified_base (328)..(328): a, c, t, g, unknown or other
  modified_base (346)..(346): a, c, t, g, unknown or other
  modified_base (399)..(399): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccgaggagggacagtcactctcacctgtgctcagcacgtggagctgtcacaatggtctattactccctactggttaccaacagaacgcctgacccaacgcccccaggaccactgatttangataaacaaacaaacaaacactacncgacccctgcccggttcncgacgctcccgtcggttcggggacaacgcctcgcccgttcgtccgtttcgggnccgcgacgctgaggataggagtcgtaggtagttacttacgtcgtacttcgtccttactcgttaagttacggttggtttcgggtttcggggttcgggtttacgggcgggaacgggaaccgtaaggtcgtacggacccgttacgttacggacgtaaccgccggtaaacggcccgtttccggacccccgttcgggtaaccctctacccgttccgttcccccaccttccctacgttaccggtaccttacgccgg

SEQ ID NO: 374294 - DNA, 620 bp, Homo sapiens
  misc_feature: GZ8MTXP02F5AVC.17.31.C09.1.454.CMB.2.raw
  modified_base (266)..(266): a, c, t, g, unknown or other
  modified_base (341)..(341): a, c, t, g, unknown or other
  modified_base (390)..(390): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtccccgaggagggacagtcactctcacctgtcggctcagcactgganctgcaccatgtcatatccctatcggttaccaacagaacgccgtggacccaacgcccccaggaccacgtgatttancgaatacaaaacgaacaaacacctcctcggccccctcggtcccggttcnccgacgtcctcccgtcggtggggacaagctacgccctacgtcccgtttgggcgtcgcgacgtccggtaggaggagttggaggtcgtagtaacgttgtttacgtcgttcttggtacccttcgttacccgtagttacgggttgggttcgggtttcggggttacgggttccggggacgggacgggtaccgaacggtccgtacgtacccggtccgtaaggtcccgacgacccgg

SEQ ID NO: 374295 - DNA, 620 bp, Homo sapiens
  misc_feature: GZ8MTXP02FFAQH.17.31.C09.1.454.CMB.2.raw
  modified_base (164)..(164): a, c, t, g, unknown or other
  modified_base (169)..(169): a, c, t, g, unknown or other
  modified_base (202)..(202): a, c, t, g, unknown or other
  modified_base (224)..(224): a, c, t, g, unknown or other
  modified_base (243)..(243): a, c, t, g, unknown or other
  modified_base (258)..(258): a, c, t, g, unknown or other
  modified_base (267)..(267): a, c, t, g, unknown or other
  modified_base (296)..(296): a, c, t, g, unknown or other
  modified_base (316)..(316): a, c, t, g, unknown or other
  modified_base (332)..(332): a, c, t, g, unknown or other
  modified_base (345)..(345): a, c, t, g, unknown or other
  modified_base (398)..(398): a, c, t, g, unknown or other
  modified_base (436)..(436): a, c, t, g, unknown or other
  modified_base (481)..(481): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccaggtccaattcccaggctgtggtgactcagganccctnactgactgtcgtcccgaggaggacagtcactcncacctgtgctccagcactgganctgtcacaatgtcattacnccctatggtaccaanagaacgccngaccaacgcccccaggacactgtatttanagaataacaaacaacaaacnctccgtaccggacccncggacccggttcncgacgtcctccgtcgggtacggggacaaagtctcgccctgtccccgttgggcncgccgagcgtgacgagtgacggtcgtagtagtattacngtcttcgcttactcgtagtagtgggttcgttcgggagttcggggnggtacggaccaggtccgtacgacccgtcgtaacggcgtaaccgcccgaacgggtccccgacccggtcccccgtacgttcccacccgtttcccgtccccgttaccccctacccgtcccttaccgtacgcccgtacgtcgg

SEQ ID NO: 374296 - DNA, 646 bp, Homo sapiens
  misc_feature: GZ8MTXP02JEVQ1.17.31.C09.1.454.CMB.2.raw
  modified_base (226)..(226): a, c, t, g, unknown or other
  modified_base (304)..(304): a, c, t, g, unknown or other
  modified_base (323)..(323): a, c, t, g, unknown or other
  modified_base (346)..(346): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgcaccaatggtcattactccctactcggttccaacagaacgcctggaccaacgcccccaggaccactgtactttangactaacaaacaacaaacnctcctcggaccctcgccggttcncgacggcctccgtcggttcggggacaacgctacgccctgtcccgtttcgggcgcgtcagtccgtaggaggtactggaacggtctgagttagttacgtggtcttgtcctctacgtagtcggttgggttcgggttcgggtcggtttacggggacggtacgggaaccgtaacggtcgtacggtacccgttacgtacgggtaccacggaccccggtaaggcccgtccggtacccccgttcggtacctacccgttccgttcccgtccccggtaccctcccgttacgtaccggtccttacggccgg

SEQ ID NO: 374297 - DNA, 666 bp, Homo sapiens
  misc_feature: GZ8MTXP02H6C8K.17.31.C09.1.454.CMB.2.raw
  modified_base (226)..(226): a, c, t, g, unknown or other
  modified_base (301)..(301): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtacaccaatggtcattatccctactggttccaacagaacgcctaggccaacgcccccaggacactgatttanagaataacaaacaaacaaacctactaccgtaccgtacccctcgtccgttctacgaccggtccgtccgtccggtacggggactaacgtccgtcgacccgttcgtcccgtttcgggcgcgcgacgtcgtagagagtgagtcgtagtagttattacgtcgttcgttcgtcttaccgtacttagttaggttgggttgggtttcggggttcgggttacggggacgggtaacggaccgaggtacggtaccgtaccggtaccgtacggtccgaaccggacccggtacggtcccgtcccggtccccgtaccgtacctaccgttccttccccgttccccctccccttccctcccgttacgtaccgtaccggtcg

SEQ ID NO: 374298 - DNA, 656 bp, Homo sapiens
  misc_feature: GZ8MTXP02HVKM1.17.31.C09.1.454.CMB.2.raw
  modified_base (354)..(354): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtgactcaggacgccctcactgactgtcgtcccaggagggacagtcactctcacctgtgctcagcacgtggagctgtcaaccaagtggtacatttactccctacgttcggttacaaacgagaacgccgtcggaccaaaccgccccaaggacacgtagactttanacgtaacaaacaaaacaacaaacgtacctaccgtccgtaccctcgtacccgttctaccgacgtcccttcccggtcggggttcgggaactaacgtctccgtcccgttaccggtcccggtttcgggcgccgacgacgccgtaggaggtagtacggacgtcgtagtacgttacgtacgtcgtcttacgtccgttaccgttacgttaggttacgggttgggttcggttcggggttcggttaccgggacgggtaacggacgtaacggtccgtaccggtaccggtacgtacggtacgaccggtacccg

SEQ ID NO: 374299 - DNA, 671 bp, Homo sapiens
  misc_feature: GZ8MTXP02IZ93F.17.31.C09.1.454.CMB.2.raw
  modified_base (255)..(255): a, c, t, g, unknown or other
  modified_base (259)..(259): a, c, t, g, unknown or other
  modified_base (284)..(285): a, c, t, g, unknown or other
  modified_base (394)..(394): a, c, t, g, unknown or other
  modified_base (399)..(399): a, c, t, g, unknown or other
tcagcgtagactagcacgaccggtgctcgatttagacgtctcatcaaggaaggaaggggaccaggggtcccttccaatatcagcaccatggcctggactcctctcttttctgttcctcctcacttgctgcccagggtccaattcccaggctgtggtgactcaggagccctcactgactgtgtccccaggagggacagtcactctcacctgtggctcagcactggagctgtcaccatggtcattatcctatgtcanaganctgcacgccccagacactgtattannataacaaacaacaacactccgtacgacccctcgcccgttctcgacggcctccgtcggtcggggacaacgctcgacccttcgtccggtttcggtcgccgcgtcgccgtgngacgnggacgctaggagttacgttactgtcttcgtctctacgttagttggttcggttcgggtttcggggtcgggttcggggaccgggaaacgggtaccgaacggtccgttaccggacccggtttaccgtacgggtacccgtacggaccccgtaaaggtcccccgttcccggtacccccgtttcccgggtacccttaccgttcccgtttccccggttccccccgggtaacccctttcccccgggtaacctttcccggttaaccgttaccccggtcggg

SEQ ID NO: 374300 - DNA, 584 bp, Homo sapiens
  misc_feature: GZ8MTXP02IMXHU.17.31.C09.1.454.CMB.2.raw
  modified_base (245)..(245): a, c, t, g, unknown or other
  modified_base (312)..(312): a, c, t, g, unknown or other
  modified_base (332)..(332): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctccagcactggagctgtcaccatggtcattacnccctactggttccaacagagctgccacgccccagacactgattatgataacaaacaacaaacactcncgacccctgcccgttctcgngctcctccgtggggcaaagctacgcccgtgtcccgttcgggtcgcgcacgtcctagacggatgaggcgtagaggttaataacgtgtacgttgtctctcctattagtggttgtttacgggtggttacgggacggtacggacgaagtcgtagacccgtccgtagtcgtacgaccgaacggcctacggcccccttacgggtcctaccgttcctccgttccccacccgttccctacctccggtacttaccggtacg

SEQ ID NO: 374301 - DNA, 866 bp, Homo sapiens
  misc_feature: GZ8MTXP02G988G.17.31.C09.1.454.CMB.2.raw
  modified_base (222)..(222): a, c, t, g, unknown or other
  modified_base (232)..(232): a, c, t, g, unknown or other
  modified_base (246)..(246): a, c, t, g, unknown or other
  modified_base (320)..(320): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctggtggtgactcgaggacgccctcactgactgtcgtccccgaggagggacagtcactctcaccgtgtgctccngcagtggacntgtcaacagtcgtntattactcctacgtcgtaccaacagaacgccgtacgacccaaccgcccccgaaggaacacgtagtaactttaanacgaaataaaccaaaacaaaaccaacctaccgtaccgtaaccggtaccccctcggtaccccgttctaccggtaccggtccccgttccccggtacggggttacggggaacctaaacggtccccttaccggtcccccgttaccgggtttacccccggggtttcggggccggtcccgaacccgttaccggacccggtagggtaacgggtaacgtcgggaaacgggttaccgttacgggtaaggttaaccttttacgggtctttccgggttaaacccttcccggttaccctttaaccggtttaaaggtttccggggtttagggggttttcccgggggtttacggggtccggggttttacgggggaacccgggtaccggggtaaacgtacccggtccggtaacccggttaccccgtacgggtaacggtcccggtaaaccgtaccccggtaaggtccccctaacccccggttccccggtccgttacccgtccgttccccgttcccggtccccctcccggttaccccctagtccgtaaccgttacgtccgggg

SEQ ID NO: 374302 - DNA, 858 bp, Homo sapiens
  misc_feature: GZ8MTXP02FK63E.17.31.C09.1.454.CMB.2.raw
  modified_base (164)..(164): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccaggtccaattcccaggctgtggtgactcagganccctcactgactgtcgtccccaggagggacagtcactctcacctgtcgctccagcacgtggagctgtacaaccaatggtctattactcccctacttcggttacccaacgtaacgaaacgtccgacgggaccaaaccggcccccccgaaggaacctaccgtacggtaaatttagtaggaaactaaccaaaaacgaaaccaaaaccgtaacctcccgtaccggaacccccgtcggtcccccggtttacgtaccgacgggtcccctacccggtttcccggggttacgggggaaccaaacggtcgtccggtaccccgttccggtttacccccgtttcgggggtccgcgtaccgacgtccggtaggagggtactaggggaccggtagtacggtaacggttactttaccgtggtccttcggtaccttccgttacttacggttaacggttggggtttcggggttacgggggtttcgggttaccggggggtacgggtaaaccgggtacccggtacggtaccggttaccggtaccgggttacccgtaaacggggtccgtaacgggtaccccgaacgggtcccgtccccggttacccccggttccggttaaacccgtccggtttccccgttaaccccgggtttccccccgtaacccctttccccgggttccctttaaccgggttcccttaacccggggttccgg

SEQ ID NO: 374303 - DNA, 820 bp, Homo sapiens
  misc_feature: GZ8MTXP02GNXDL.17.31.C09.1.454.CMB.2.raw
  modified_base (271)..(271): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggcctgtggtgactcgaggacgccctcactgacctgtcgtccccgaggagggacagtcactctcacctggtcgctccagcacgtgganctagtcaccaatggtactattactcccctattcggttaccaaacgacgtaagcccgttggacccaaacccgcccccgaagggaccctaaccgtgtaacgtttttaagacgtaaacctaaaccgaaaaaccaaaccaaaacctacccttcccggtaccggggtaaccccccttcgggtacccccggttttacccgacccgtacgggtcccctttccccggttaccggggtttacggggggaaccctaaaaccggtccgtacccggtacccccgtttaccggttacccccggttttccgggggtacggcccggttacgaaccgggtccccggtttagggaacgggttacggtaggtacgggttaccggtaaggtaacccgtttagtttaaacccgtgggtaccgtttgtcccgttaccttaccgtttaaacgtcgggtttgggtttcggggtttccgggggtacgggtttccgggggacggggaacgggtacccgaagggttccgtaacggtaccccggttaccggtcggttacccgaccgtaaccccggg

SEQ ID NO: 374304 - DNA, 798 bp, Homo sapiens
  misc_feature: GZ8MTXP02GL9KS.17.31.C09.1.454.CMB.2.raw
  modified_base (214)..(214): a, c, t, g, unknown or other
  modified_base (233)..(233): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccaggtccaattcccaggctgtggtgactcaggacgccctcactgactgtcgtccccgagggacggacagtcactctcaccgtgnggcctccagcacgtggacnctcgaccaacctaagtcgtactacttactccctacgttacgtaccaacgagaactccgacgacccaaccgcccccgtaaggacctacgtagtatttaacgacaaactaaaccaaaacctaaaccaaaacgtaccctacccggtacccgtaaccccgttccggtaccccgttactaccgtaccggtcccttacccgggtcggggttaaccggggaactaaaccggtccgtaccgtccccgttacggttaccccgggtttcgggcgaccgaccgttacggacggtaaggagggtacgtacgggtacggtcgtaagggtaactttaacgttccgtggttccttacgtcttaccgtacgttagggtttgttacggggtttcggggttacggggtttacggacgggggaccggtaacgggtaaccgtaggtacccgtacggttaacccggtcggttaaaacggccgtaaccgggaacccggtacggtccccgttccgccccggttacgccttacccggtttcgtcccccggttccctacccttacgtaccgttaccgtcgtacggtccgg

SEQ ID NO: 374305 - DNA, 715 bp, Homo sapiens
  misc_feature: GZ8MTXP02I93DF.17.31.C09.1.454.CMB.2.raw
  modified_base (193)..(193): a, c, t, g, unknown or other
  modified_base (203)..(203): a, c, t, g, unknown or other
  modified_base (234)..(234): a, c, t, g, unknown or other
  modified_base (267)..(267): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctgtggtnactcaggacnccctcactgactgtcgtcccgagggaggacngtcactctcacctgtcggctcagcacgtggacnctgtaccacagtgtactacttactccctagtcgtaccaagacgaacgccgtacggaccccaaaccgcccccaaggaacctacgtacgtaattttacgacgtaaactaaaccaaaaacaaacctaaacctacccgttaccgtcccggggtaacccccttccgggtacccccggtttcctaccgtaccggtccccgttcccggttcggggtacgggggaacctaacggcccgttccgtaccccgtcggttaccccgtttggggcctacgcgacgtccgtaggacggtgtacggacgtacgtaggtaactttacgtcgttcgtcgttcgtcctttcgtacctttaaggttcgggttcgggttcgggtttacggggtccggttcgggggaaccgggtacggtaaccgaaggtcccgtacggtacccggtcgttacgccgtaaccggacccgg

SEQ ID NO: 374306 - DNA, 756 bp, Homo sapiens
  misc_feature: GZ8MTXP02ISEL5.17.31.C09.1.454.CMB.2.raw
tcagcgtagactagcacgaccggtgctcgatttagacgtctcatcaaggaaggaaggggaccaggggtcccttccaatatcagcaccatggcctggactcctctctttctgttcctcctcacttgctgcccaggtccaattcccaggctgtggtgactcaggagccctcactgactgtgtccccaggagggacagtcactctcacctgtgcctccagcactggagctgtcaccaatggtctattactccctatcggttaccaacagaacgcctggccaacgccccagaccactcgtattactagataacaaacaaacaaacctactacctaccggaccccctcggtccccggttctccgtacggtccctcccgttaccgggtttacgggggactaaacggtcgtaccgtcccgtcggtaccccggtttggggtcgtaccgccgtacgggtccgtagggacggtagacggcggcgtaggtagttacgtttacgtcgtcgttcgtccttcctaccgtaagtttggtggggtttacggggtttcggggtttcgggttacgggggaccggtacgggggtaccgaaggaccggttacggtacccggttaccgtaacgggtacccacgggtaccccgtaacgggtcccttcccgggtcccccttcgggttaacctacccggtttcccgtttccccggtttcccccccggttaacccctttaccccgtcccgtttacccggtttaccggaacccgtacccggg

SEQ ID NO: 374307 - DNA, 777 bp, Homo sapiens
  misc_feature: GZ8MTXP02GGZGP.17.31.C09.1.454.CMB.2.raw
  modified_base (337)..(337): a, c, t, g, unknown or other
  modified_base (574)..(574): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggacgccctcactgactgtcgtccccgagggacggacagtcactctcacctgtcgctcagcacgtggagcttgaccaacaagttcggtactatttactacccttacgtcggttaccaacgagaacgtccgacggacccgaaccggcccccgaaggtacctacggtacttaatttanaagtaacttaaaactaaaacctaaacctaaaacccgaccttaccggaccccggtacccccgttaccggtcccccgttcgtaccgtcggtccccgttcccggtaccggggttacgggggacctaaccggtcgtcccggtcccgttacccgggttcccgggtttccgggtcggaccgtccggacgtccggtagaacgggtgtacgggacggtccgtaaggtaggttaacttcgttcgtnttcccgttacttccgtagttaggttcgggtcgggtttgggtttccggggtacgttacgggggaccgtacggacgtacggtcggtaacgtcccggtttaacggcgtaccgaccggtaaccgcggtcccgtcccgtcccggtaacgtccctccggttcccgaaccccgtttccccgtccctaccgttccgtctacgtacgtcggg

SEQ ID NO: 374308 - DNA, 698 bp, Homo sapiens
  misc_feature: GZ8MTXP02HH5VV.17.31.C09.1.454.CMB.2.raw
  modified_base (309)..(309): a, c, t, g, unknown or other
  modified_base (334)..(334): a, c, t, g, unknown or other
  modified_base (360)..(360): a, c, t, g, unknown or other
  modified_base (451)..(451): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggacgccctcactgactgtcgtcccgaggagggacagtcactctcactgtgcctcagcagtggagctgtcacaatcggtctattactcccgtagtcggttaccaagagaacgcctacgaccaaccgccccaagaccacgtgtatttangaaactaacaaaacaaacgaaaacnctaccgtcgacccgtcgtacccgtcncgacgtccctcggtcccgggtaggggaccaacgtcctcgtccccgttcggtcccggtttgggactccggacacggtccgtggaaacgggtntcgggagtcgagttaggttacttcgcgttcttcgaccttcgttacgtaggttcggttggtttcgggtttcgggtcgggttacgggggacggacggtaccgtaacgtccggttacggtaaccggttccgtacgggtaccgaccggtacccggtaaccggtcccgcccccggttcccgttaccggtacccttcccgtccgttccccggttccccgtacccttccgtaccgtaccgttaccgtacgtcgg

SEQ ID NO: 374309 - DNA, 702 bp, Homo sapiens
  misc_feature: GZ8MTXP02FRH7G.17.31.C09.1.454.CMB.2.raw
  modified_base (260)..(260): a, c, t, g, unknown or other
  modified_base (293)..(293): a, c, t, g, unknown or other
  modified_base (311)..(311): a, c, t, g, unknown or other
  modified_base (401)..(401): a, c, t, g, unknown or other
tcagcgtagactagcacgaccggtgctcgatttagacgtctcatcaaggaaggaaggggaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcacaatgtcattatccctatggttccaanagaagctgccaagcccccaggacactgatttangatacaaacaacaaaacnctaccctacggacccctcgcccggttctcgacggccttcccgtcggttacggggacaaaggcctacggccccgttcgccccgtttcgggngtccggtaccacggaccgtgggacggataggacggtccgtaggagtttattaccgtggtcttcgcttcctaccgttaggttagtccgggttggttcgggggtttacggttccgggggtaccgggtaacggggaacccgtaacggtccgttacggggtacccgttaccggtaagggttaaccggacggaaccccgaaacgggtaccgttcccggtaccccccgtcgggttaccccactttccccgttccgtttacccccctaccggttcccccttaccggtactttcccggttacccgtcgg

SEQ ID NO: 374310 - DNA, 647 bp, Homo sapiens
  misc_feature: GZ8MTXP02FG52J.17.31.C09.1.454.CMB.2.raw
  modified_base (207)..(207): a, c, t, g, unknown or other
  modified_base (212)..(212): a, c, t, g, unknown or other
  modified_base (244)..(244): a, c, t, g, unknown or other
  modified_base (266)..(266): a, c, t, g, unknown or other
  modified_base (322)..(322): a, c, t, g, unknown or other
  modified_base (345)..(345): a, c, t, g, unknown or other
  modified_base (364)..(364): a, c, t, g, unknown or other
  modified_base (372)..(372): a, c, t, g, unknown or other
  modified_base (397)..(397): a, c, t, g, unknown or other
  modified_base (421)..(421): a, c, t, g, unknown or other
tcagcgtagactagcacgaccggtgctcgatttagacgtctcatcaaggaaggaagggggagataaagagccatcagaatccagccccagctctggcaccaggggtccccttccaatatcagccaccatggcctggacctcctctctttctgttcctcctcacttgctgcccagggtccaattcccaggctgtggtgactcaggacnccctnactgactgtcgtcccgaggtaggacagtcacncgtcaccgttgcggcctccgancacgtggagcttgcaccgaatcggctactttaactccctactcggttaccaaacgngaaacgccgtaggaccccaaccncccccgaaggacctaccgntatttacnctacaacaaaacaaacaaacgtccncgtccgaccctcgtccggttaccncgtacgtccgtcccggttacggtacgggaactacgcgtccgtcccgtaccgtccgttcgggcgcggtacgccgacgtggaggtgtaggcggtagtagtacgttactacgtgttactcgtcttacgtacgttacggttgggttacggttcgggttccggggtcggtaccgggacggaaccggtacgaacgtccggtaccgtaccggtcgtacggaccgacgtacccg

SEQ ID NO: 374311 - DNA, 683 bp, Homo sapiens
  misc_feature: GZ8MTXP02HCIAQ.17.31.C09.1.454.CMB.2.raw
  modified_base (249)..(249): a, c, t, g, unknown or other
  modified_base (560)..(560): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctctttctgttcctcctcacttgctgcccagggtccaattcccaggctggtggtgactcgaggacgccctcactgactcgtcgtccccgaggacggacagtcactctacncctggtcgcctccgagcacgtggagctagtccaaccaagtcgtacattacctacccttagtcggttaccaacgacgaacgccgtacggacctaacccggccccgaaggacctacgtattactttagcgtaaactaacaaaacaaacaaacgaccttccgaccggtacccctcggccccgttactaccggacgtcccttaccccggttacggggttacggggaactaacggtccgtccgtacccgtcggttacccggttcggcggtacgcgacgcgtcggagtacgtggcgtagtagttagtacttccggtnttcgtcgtcctcgttacgttagttacggggttcgggttacgggttcggggtacgggttaccggggaccggtacggtaaccgcgtcggtaccggtaccgtacggtaccgtaccggaccgtaccg

SEQ ID NO: 374312 - DNA, 705 bp, Homo sapiens
  misc_feature: GZ8MTXP02HVFS6.17.31.C09.1.454.CMB.2.raw
  modified_base (208)..(208): a, c, t, g, unknown or other
  modified_base (263)..(263): a, c, t, g, unknown or other
  modified_base (265)..(265): a, c, t, g, unknown or other
tcagcgtagactagcacgaccggtgctcgatttagacgtctcatcaaggaaggaaggggagataaagagccatcagaatccagccccagctctggcaccaggggtcccttccaatatcagcaccatggcctggactcctctcttttctgttcctcctcacttgctgcccagggtccaattcccaggctgtggtgactcaggagccctnactgactgtcgtcccaggtaggacagtcactctcacctgcggctcagcactggancngtcaaccaagtggtactattactccctactaggttacccaaactaacgtaacgcctacggacccaaaccgcccccgaaggacctaccgtagtaactttacgtacgtaactaaccaaaacaaaacctaaacacccttaccgccgggtaaccccctacggtccccgttacgtaccgacggccttaccccggtcgggttacggggaacttaaacgccgttacggaccccgttacggtacccccgtttcggggtcgtccgaccgacgtacccggttggaaaggtaccttaggggacgtaccgttaggtaaacgttacgttaacgtcgtccgggtttgaacccttcggtacctttaggtacgtttcgggttaggttcgggtcggttacgggacggttaggaaccgaacggtcacggtcccgtactacgggtaccacggtaccccg

SEQ ID NO: 374313 - DNA, 518 bp, Homo sapiens
  misc_feature: GZ8MTXP01CE5IS.21.19.B08.1.454.CMB.2.raw
  modified_base (461)..(461): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtaccatagtatgaattggatccgcaggctccaggaaaggggctggagtggctctcacagattagtggtagtagtagtttcatatattaacgcaagactcagtgcagggccattcaccatctccagagacaacgccaagaattccctgtatctggcaaatggacagcctgagagtcgaggacacggctaangttattacttgtgcgggttggcttgggggcgggatgacagcgtggggccgaacgggg

SEQ ID NO: 374314 - DNA, 451 bp, Homo sapiens
  misc_feature: GZ8MTXP01ELICW.21.19.B08.1.454.CMB.2.raw
  modified_base (448)..(451): a, c, t, g, unknown or other
tcagtcgtcgctcgcacgaccggtgctcgatttagtgagtcagtaagagaaagggtctggagtggattgggagtgtctataatacggggagtcaatatcgtggtgacactccctactacaacccgtcttttaagagtcgagtcactatatcagtgcgctcgtccacgaaccaggtctccctgaggatgagatctgtgacggccgcagacacggccaagtatttctgtgcgagagaccccggagttagcgacgcctggaggcactggtacttcgatgcctggggccgtggcgccctggtcactgtctcatcagcttccaccaagggcccatcggtcttccccctggcgccctcgctcaggagcaacctctgggggcacagcggccctgggctgcctggtcaaggctacttcccgagcgacgactgagcgggctggcgaaggcgcatagnnnn

SEQ ID NO: 374315 - DNA, 517 bp, Homo sapiens
  misc_feature: GZ8MTXP01BLJJ9.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtaccatagtatgaattggatccgcaggctccaggaaaggggctggagtggctctcacagattagtggtagtagtagtttcatatattaacgcaagactcagtgcagggccgattcaccatctccagagacaacgccaaagaattccctgtaatctggcaaatggacagcctgagagtcgaggacacggctaatgttattacttgtgcgggttgcttgggggcgggatgacagctggggcaacgggg

SEQ ID NO: 374316 - DNA, 515 bp, Homo sapiens
  misc_feature: GZ8MTXP01EQQNU.21.19.B08.1.454.CMB.2.raw
  modified_base (351)..(351): a, c, t, g, unknown or other
  modified_base (364)..(364): a, c, t, g, unknown or other
  modified_base (473)..(473): a, c, t, g, unknown or other
  modified_base (502)..(502): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggaggcctggtcaagcctgggggtccctgagactctcctgtgcagcctctggatccgccttcagtaccatagtatgaattggatccgccaggctccaggaaaggggctggagtggctctcacagattagtggtagtagtagtttnatatattaacgcngactcagtgcagggcattcaccatctccagagacaacgccaaagaattccctagtatctggacaaatggaacagcctgagagtcgaggacacggctaatgttattacgngtgcgggttgcgttggggcgggatgacgngcgtgggcgaagg

SEQ ID NO: 374317 - DNA, 513 bp, Homo sapiens
  misc_feature: GZ8MTXP01B3ACF.21.19.B08.1.454.CMB.2.raw
  modified_base (364)..(364): a, c, t, g, unknown or other
  modified_base (469)..(469): a, c, t, g, unknown or other
  modified_base (497)..(497): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctgggggtccctgagactctcctgtgcagcctctggatccgccttcagtacctatagtatgaattggatccgccaggctccaggaaggggctggagtggctctcacagattagtggtagtagtagtttcatatattaacgcngactcagtgcagggccattcacatctccagagacaacgccaagaattccctgtatctggacaaatggaacagcctgagagtcgaggacacggctaatgttatacngtgcgggttgcgttggggcgggatgacngcgtggggcgaacggg

SEQ ID NO: 374318 - DNA, 530 bp, Homo sapiens
  misc_feature: GZ8MTXP01D2O20.21.19.B08.1.454.CMB.2.raw
  modified_base (368)..(368): a, c, t, g, unknown or other
  modified_base (421)..(421): a, c, t, g, unknown or other
  modified_base (459)..(459): a, c, t, g, unknown or other
  modified_base (463)..(463): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgcaggctccgaggaaaggggctggagtggctctcacagtattaggtggtagtagtagtttcatatattaacgcngactcagtgcaggggcattcacatctccagacgaacaacgccaagacttcccngtatctggacaaagtggacagcctgagagtcgaggacncggntaatgttattacgttgtggcgggttggcggttgggggcgggatgacgaggcgtcggggcgaacgggg

SEQ ID NO: 374319 - DNA, 524 bp, Homo sapiens
  misc_feature: GZ8MTXP01D0G22.21.19.B08.1.454.CMB.2.raw
  modified_base (336)..(336): a, c, t, g, unknown or other
  modified_base (401)..(401): a, c, t, g, unknown or other
  modified_base (423)..(423): a, c, t, g, unknown or other
  modified_base (466)..(466): a, c, t, g, unknown or other
  modified_base (480)..(480): a, c, t, g, unknown or other
  modified_base (511)..(511): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtacctatagtatgaattggatccgcagctccaggaaggggctggagtggctctcacagattagnggtagtagtagtttcatatattaacgcaagactcagtgacgagggcgtattccacatctccaganaacaacgaccaaagaattcccngtaatctggacaaagtggacagcctgagagtcgaggacacggntaatgttattacgngtggcgggttggcgttgggggcggatgacgngcgcgggcgaagg

SEQ ID NO: 374320 - DNA, 542 bp, Homo sapiens
  misc_feature: GZ8MTXP01D2NAZ.21.19.B08.1.454.CMB.2.raw
  modified_base (404)..(404): a, c, t, g, unknown or other
  modified_base (486)..(486): a, c, t, g, unknown or other
  modified_base (515)..(515): a, c, t, g, unknown or other
  modified_base (520)..(520): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggatccgcaggctccgaggaaaggggctggagtggctctcacagattagtggtagtagtagtttcattatattaacgcaagactcagtgcgacggggcattcacatctcaganacaacgcaaagacttccctgtactctcggaacaaagtcggaacagccgtgagagtcgaaggacacggctaatgttattacgnggtggcggggttggcggttgggggcgggntcggngaggcgtcggggccgaacgggg

SEQ ID NO: 374321 - DNA, 454 bp, Homo sapiens
  misc_feature: GZ8MTXP01AF7QD.21.19.B08.1.454.CMB.2.raw
  modified_base (450)..(454): a, c, t, g, unknown or other
tcagtcgtcgctcgcacgaccggtgctcgatttagtgagtcagtaagagaaagggtctggagtggattgggagtgtctataatacggggagtcaatatcgtggtgacactccctactacaacccgtcttttaagagtcgagtcactatatcagtgcgctcgtccacgaaccaggtctccctgaggatgagatctgtgacggccgcagacacggccaagtatttctgtgcgagagaccccggagttagcgacgcctggaggcactggtacttcgatgcctggggccgtggcgccctggtcactgtctcatcagcttccaccaagggcccatcggtcttccccctggcgccctgctccaggagcaaccctctgggggcacagcggccctggggctgccctggtcaaggctacttcccgagcgacgactgagcgggctggcaaggcgcatagnnnnn

SEQ ID NO: 374322 - DNA, 554 bp, Homo sapiens
  misc_feature: GZ8MTXP01BJETT.21.19.B08.1.454.CMB.2.raw
  modified_base (339)..(339): a, c, t, g, unknown or other
  modified_base (495)..(495): a, c, t, g, unknown or other
  modified_base (528)..(528): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggatccgccttcagtaccatagtatgaattggatccgccaggctccgaggaaaggggctggagtggctctcacagattagnggtagtagttagttcatatattaacgcaagactcagtgcgtaggggcctattccaacctatctaccaagagaaccaacgaccaaagaaacttccctagtatctggacaaagtcggactagcctgagacgtcgaggacacggctaatgttattacgngtacggcggggttgcggttgggggaacggggtntggacgaggcgtggggccgaacgggg

SEQ ID NO: 374323 - DNA, 533 bp, Homo sapiens
  misc_feature: GZ8MTXP01B6QCK.21.19.B08.1.454.CMB.2.raw
  modified_base (368)..(369): a, c, t, g, unknown or other
  modified_base (397)..(397): a, c, t, g, unknown or other
  modified_base (421)..(421): a, c, t, g, unknown or other
  modified_base (463)..(463): a, c, t, g, unknown or other
  modified_base (477)..(477): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgccaggctccgaggaaaggggctggagtggctctcacagattagtggtagtagtagtttcatatattaacgnngactcagtgcgaggggccattcacatcnccagagacaacgccaagacttccngtatctggacaaagtggacagcctgagagtcgaggacacggntaatgttattacgngtaggcgggttggcgttggggggcgggatggacgtggcgtcgggggccaacggggg

SEQ ID NO: 374324 - DNA, 521 bp, Homo sapiens
  misc_feature: GZ8MTXP01B4O9F.21.19.B08.1.454.CMB.2.raw
  modified_base (413)..(413): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctgggggtccctgagactctcctgtgcagcctctggatccgccttcagtaccatagtatgaattggatccgcaggctccaggaaggggctggagtggctctcacagattagtggtagtacgtagtttcatatattaacgcaagactcagtgcagggccgattcacatctcagagacaacgcaagacttccngtatctgcaaatggacagcctgagagtcgaggacacggctaagtgttattacttggtagcggggttggcgttgggggcgggagtgacgaggcgtggggccgaacgggg

SEQ ID NO: 374325 - DNA, 547 bp, Homo sapiens
  misc_feature: GZ8MTXP01EYR1H.21.19.B08.1.454.CMB.2.raw
  modified_base (369)..(369): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtacctatagtatgaattggatccgccaggctccgaggaaaggggctggagtggctctcacagattagtggtagtacgtagtttcatatattaacgcngactcagtgcgagggccattcacatctcagagacaacgccaaagaacttccctgtaactctaggactaaagtggaactagcctagagaggtccgaggacacggtctaagttgttattacttggtcggcgggttggcgttgggggcgggatcggacgtaggcggtggggccgaacgggg

SEQ ID NO: 374326 - DNA, 584 bp, Homo sapiens
  misc_feature: GZ8MTXP01CR78X.21.19.B08.1.454.CMB.2.raw
  modified_base (355)..(355): a, c, t, g, unknown or other
  modified_base (508)..(508): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgcaggctccgaggaaggggctggagtggctctcacagattagtggtagtagtagtttanatatattaacgcaagactcgagtgacgagggccgattccacatctaccagacgacaacgaccaaagtacttccctagtactcgtaggaactaaagtcggacacgccgtaggagtaacggtcggaaggaccacgggtctaagtgttatttacgnggtacgggcggggttcggcgggttcgggggaacgggacgtcgggaacgtgggcggtcgggggccgtaacccggggg

SEQ ID NO: 374327 - DNA, 538 bp, Homo sapiens
  misc_feature: GZ8MTXP01BOXI7.21.19.B08.1.454.CMB.2.raw
  modified_base (412)..(412): a, c, t, g, unknown or other
  modified_base (450)..(450): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctggggaggcctggtcaagcctggggggtccctgagactctcctgtgcagcctctggatccgccttcagtaccatagtatgaattggatccgcaggctcgaggaagggctggagtggctctcacagattagtggtagtagtagtttcatatattaacgcaagactcagtgcgaggccgtattcacatctcagagacaacgcaagacttccngtatctaggcaaagtcggacagcctgcgagtcgagacncggctaatgttattacgttggtcggtcgggttggcggttagggggcgggggtatcggacgagggcggtcgggggaacccgtaacgggg

SEQ ID NO: 374328 - DNA, 557 bp, Homo sapiens
  misc_feature: GZ8MTXP01D6PP0.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggatccgcaggctcgaggaagggctggagtggctctcacagtattagtggtagtagtagttcatatattaacgcaagactcagtgcgaggggcctattccactatcctacagagaacaacgaccaaagtaacttccctagtaactctaggactaaagtcggaacagcctggagagtcgaaggacacggtctaatgttattacgttggtggcggggttggcggttggggggcgggtatggacgaggcgtcgggggccgtaaccgggg

SEQ ID NO: 374329 - DNA, 556 bp, Homo sapiens
  misc_feature: GZ8MTXP01EXRIH.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggatccgcttcagtacctatagtatgaattggatccgcaggctccgaggaaagggggctggagtggctctcacagtattagtggtagtagtagtttcatatattaacgcaagactcagtgcgaggggcctattcacctatcctaccagagaaccaaacgccaaagaacttcccctagttaatcctaggggactaaagtgggacagccctagaggacgtcgaggacacggctaagtgttattacgttgtggtcgggttggcggttgggggcgggatggacgagcggtgggccgaacggg

SEQ ID NO: 374330 - DNA, 578 bp, Homo sapiens
  misc_feature: GZ8MTXP01CQ4TD.21.19.B08.1.454.CMB.2.raw
  modified_base (511)..(511): a, c, t, g, unknown or other
  modified_base (525)..(525): a, c, t, g, unknown or other
  modified_base (545)..(545): a, c, t, g, unknown or other
  modified_base (550)..(550): a, c, t, g, unknown or other
  modified_base (554)..(554): a, c, t, g, unknown or other
  modified_base (560)..(560): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtcagtgtgaggtgcatctggtggagtcgtgggggagcctggtcaagccgtgggggtcctgagactctcctgtgcagcctctggatcccgcttcagtacctatagtatgaaattggatccgcaggctaccgaaggaaagggggctagggagtggctctacaacgtagtaattaaggtggtaagttaacgttaggtttacaattaatagttaacgcaagactcagtgacgacggggcattaccaacctatcctaccaagacgaaaccaaacgaccaaagacttccctagtactctagggactaaaatcggaacagtccagacgagtcgaaggacacggntaagtgttattagnggtggcgggttggttcgggnggggnggancgacgnggcggtcgggcgtaacgg

SEQ ID NO: 374331 - DNA, 520 bp, Homo sapiens
  misc_feature: GZ8MTXP01BUYGX.21.19.B08.1.454.CMB.2.raw
  modified_base (364)..(364): a, c, t, g, unknown or other
  modified_base (477)..(477): a, c, t, g, unknown or other
  modified_base (506)..(506): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctgggggtccctgagactctcctgtgcagcctctggatccgccttcagtaccatagtatgaattggatccgccaggctccaggaaaggggctggagtggctctcacagattagtggtagtagtagtttcatatattaacgcngactcagtgcaggggccattcacatctccagagacaacgccaaagaacttcccagtatctggacaaagtggacaggcctgacgagtcgaggacacggctaagtgttattacgngtgcgggttgcgttggggcgggatgacgngcgtcgggcgaagg

SEQ ID NO: 374332 - DNA, 561 bp, Homo sapiens
  misc_feature: GZ8MTXP01AFKG7.21.19.B08.1.454.CMB.2.raw
  modified_base (411)..(411): a, c, t, g, unknown or other
  modified_base (500)..(500): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggatcccgccttcagtacctatagtatgaattggatccgcaggctccgaggaagggctggagtggctctcacagattagtggtagtagttagtttcattatattaacgcaagtactcaggtgcgagggccgtattccacctatcctaccaganaaccaacgaccaaagtacttccctagtactctagggacaaagtgggaactagccgtgagacgtcgaggacacggctaagtgttattacnggtggtcggggttggcggttgggggcggatcgggacgtggcggtcgggggccgtaacgggg

SEQ ID NO: 374333 - DNA, 529 bp, Homo sapiens
  misc_feature: GZ8MTXP01DVEI6.21.19.B08.1.454.CMB.2.raw
  modified_base (353)..(353): a, c, t, g, unknown or other
  modified_base (395)..(395): a, c, t, g, unknown or other
  modified_base (513)..(513): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgcttcagtacctatagtatgaattggatccgcaggctcgaggaagggctggagtggctctcacgagattagtggtagtagttagtttnatatattaaacgctaagactcagtgcaggggcattcacatcncagacgaacaacgccaagaacttccctgtatctggacaaagtgacagctagagaagtcggagacacgctaatgttatacgttgtcggcgggttggcggttgggggcgggatcgaaggngcggtcgggcgaacgg

SEQ ID NO: 374334 - DNA, 523 bp, Homo sapiens
  misc_feature: GZ8MTXP01EERC9.21.19.B08.1.454.CMB.2.raw
  modified_base (395)..(395): a, c, t, g, unknown or other
  modified_base (417)..(417): a, c, t, g, unknown or other
  modified_base (458)..(458): a, c, t, g, unknown or other
  modified_base (504)..(504): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgcaggctccgaggaaaggggctggagtggctctcacagattagtggtagtagtagtttcatatattaacgcaagactcagtgcaggggcattcacatcncagagacaacgcaagattcccngtatctggacaaatggacagcctgagagtcgaggacacggntaatgttatacttggtgcgggttggcgttgggggcgggatggacgnggcgtggggccgaacgggg

SEQ ID NO: 374335 - DNA, 551 bp, Homo sapiens
  misc_feature: GZ8MTXP01AJ7YX.21.19.B08.1.454.CMB.2.raw
  modified_base (372)..(372): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggtttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggatccgcaggctccaggaaagggctggagtggctctcacagattagtggtagtacgtagttcatatattaacgcaagactnagtgcgagggcgattcacatctaccagacgacaacgccaaagacttccctagtactcaggacaaagtggaacagccctaggagtagtcgagggtacacgggtctaagtgttattacgttggtcggcgggttggcgttgggggcgggtatggacgacggcggtcggggccgtaaccgggg

SEQ ID NO: 374336 - DNA, 520 bp, Homo sapiens
  misc_feature: GZ8MTXP01BJJZ4.21.19.B08.1.454.CMB.2.raw
  modified_base (517)..(520): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctgggggtccctgagactctcctgtgcagcctctggatccgccttcagtaccctatagtatgaattggatccgcaggctccaggaaagggctggagtggctctcacagtattagtggtagtagtagtttcagtatattaacgcaagactcagtgcgaggggccgattcacatctaccagagaacaacgccaaagtaacttccctagtaactcgtaggactaaatgggacagcctgagagtcgagggacacggctaatgttattacttgaggcggcgttggacgaaggcgcatagnnnn

SEQ ID NO: 374337 - DNA, 524 bp, Homo sapiens
  misc_feature: GZ8MTXP01B0KVR.21.19.B08.1.454.CMB.2.raw
  modified_base (416)..(416): a, c, t, g, unknown or other
  modified_base (452)..(452): a, c, t, g, unknown or other
  modified_base (471)..(471): a, c, t, g, unknown or other
  modified_base (499)..(499): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctgggggtccctgagactctcctgtgcagcctctggatccgccttcagtaccatagtatgaattggatccgcaggctccaggaaggggctggagtggctctcacagattagtgtagtagtagtttcatatattaacgcaagactcagtgcgagggccgattcaccatctccagagacaacgccaaagattcccngtatctggcaaatggacagcctgagagtcgaggacncggctaagtgttattacgngtggcgggttggcggttgggggcggggntggacaggcgtcggggcgtaacggg

SEQ ID NO: 374338 - DNA, 563 bp, Homo sapiens
  misc_feature: GZ8MTXP01CDW64.21.19.B08.1.454.CMB.2.raw
  modified_base (492)..(492): a, c, t, g, unknown or other
  modified_base (540)..(540): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcctggggggtccctgagactctcctgtgcagcctctggatccgccttcagtacctatagtatgaattggatccgcaggctccgaggaaaggggctggagtggctctcacagtattaggtggtagttacgtagtttcatatattaacgcaagactcagtgacgacgggccgtatcacatctccaagagaaccaacgccaagtaacttccctagtactctaggactaaagtggacagcctgagagtcgaggacgcggctaagtgttattcgnggtacggcggggttggttcgggttcgggggcggggtagtcggaacggnggttcggtcgggccggtaacggg

SEQ ID NO: 374339 - DNA, 556 bp, Homo sapiens
  misc_feature: GZ8MTXP01ARAM4.21.19.B08.1.454.CMB.2.raw
  modified_base (368)..(368): a, c, t, g, unknown or other
  modified_base (488)..(488): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcctggggggtccctgagactctcctgtgcagcctctgggatccgtccttcagtacctatagtatgaattggatccgccaggctccgaggaaaggggctggagtggctctcacagattagtggtagtagtagtttcatatattaacncaagactcagtgcgagggcctattcaccatctcagagacaacgcaaagacttccctgtactcaggacaaatggaacaggccctgacgagtcggaacggacgtacggctaatgttattacnggtcgggtcggggttggcgggttgggggcggggatcggaacgtggcggtcgggggaaccgaaccgggg

SEQ ID NO: 374340 - DNA, 631 bp, Homo sapiens
  misc_feature: GZ8MTXP01AS2FN.21.19.B08.1.454.CMB.2.raw
  modified_base (359)..(359): a, c, t, g, unknown or other
  modified_base (468)..(468): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcgttggggggtccctgagactctcctgtgcagcctctggactcccgccttcagtacctatagtatgaattggatccgcaggctccgaggaaggggctggagtggctctcacagtattaggtggtagtagttagtttnattatattaacgcaagtactcgagtgcgacggggcctattccactatcaccgaagacgaacaacgaccaaagaacttccctagtactctacgggacaaagtcggaaacncgtcctaggaacggtacgtacggaacggaaccgacgggtacttaagttgtttaacttaccggttgggtcgggtccggggggttgggttccgggttaggggggtaaccgggggatcgggacggacgggttccgggtaaccgggggaacccgtaaacccgggggg

SEQ ID NO: 374341 - DNA, 545 bp, Homo sapiens
  misc_feature: GZ8MTXP01C4DBX.21.19.B08.1.454.CMB.2.raw
  modified_base (362)..(362): a, c, t, g, unknown or other
  modified_base (497)..(497): a, c, t, g, unknown or other
  modified_base (524)..(524): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctgggggtccctgagactctcctgtgcagcctctggatccgccttcagtacctatagtatgaattggatccgcaggctccaggaagggctggagtggctctcacagattagtggtagtagtagtttcatatattaacgcngactcagtgcagggccattccacatctaccagacgaacaaccgccaaagtacttcccgtgtaactccttagggaccaaaagttcgggaacacgccctaggagaagtcgaacggacacggctaagtgttatttacnggtcggcggggttgcgttggggcgggntgactgcgtcgggcgaacggg

SEQ ID NO: 374342 - DNA, 547 bp, Homo sapiens
  misc_feature: GZ8MTXP01CHEWB.21.19.B08.1.454.CMB.2.raw
  modified_base (367)..(367): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcctggggggtccctgagactctcctgtgcagcctctggatccgccttcagtacctatagtatgaattggatccgcaggctccgaggaaaggggctggagtggctctcacagattagtggtagtagtagtttcatatattaacgcngactcaagtgcagggcattcacatctccagagacaacgcaaagaacttccctagtatctaggacaaatcggacagcctagagagtcgaaggacacggctaagtgttaatttacttgggtacggcggggttcgcggttcggggaacggggacgtggaacgaggcgtcggggcgtaaccggg

SEQ ID NO: 374343 - DNA, 585 bp, Homo sapiens
  misc_feature: GZ8MTXP01AQH2A.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggatcccgccttcagtacctatagtatgaattggatccgcaggctccgaggaaggggctggagtggctctcacagtattaggtggtagtagttagtttcagtatattaacgcaagactcgagtgcgacgggctattccactatctaccagacgaacaacgaccaaagtacttccctgtatctaggactaaagtggaacagtcctaggacgaggtcgaaggaccacggacttaatcgttattaccgttggtacgggtcgggggttgggttccggttggggggcggggtattcgggaaccgtgggcggtcgggggaacccgtaaccgggg

SEQ ID NO: 374344 - DNA, 566 bp, Homo sapiens
  misc_feature: GZ8MTXP01DFGKR.21.19.B08.1.454.CMB.2.raw
  modified_base (355)..(355): a, c, t, g, unknown or other
  modified_base (368)..(368): a, c, t, g, unknown or other
  modified_base (547)..(547): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggatccgccttcagtacctatagtatgaattggatccgccaggctccgaggaaaggggctggagtggctctcacagtattagtggtagtagtagtttnatatattaacgcngactcagtgcaggggccattcacatctccagacgaacaacgaccaagaacttccctagtacttccagggtaccaaaagttcgaacgtacgcctagaggtagtaccggaggaccacgggtcttaatcgttaattacgttggtggtcgggttggccgggttgggggcgggtagcgaacggnggcggtcgggccgaacggg

SEQ ID NO: 374345 - DNA, 528 bp, Homo sapiens
  misc_feature: GZ8MTXP01ESKKT.21.19.B08.1.454.CMB.2.raw
  modified_base (366)..(366): a, c, t, g, unknown or other
  modified_base (392)..(392): a, c, t, g, unknown or other
  modified_base (443)..(443): a, c, t, g, unknown or other
  modified_base (501)..(501): a, c, t, g, unknown or other
  modified_base (508)..(508): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcctgggggtccctgagactctcctgtgcagcctctggatccgccttcagtacctatagtatgaattggatccgcaggctccgaggaagggggctggagtggctctcacagattagtggtagtagtagtttcatatattaacgcngactcagtgcaggggcattcacatcnccagagacaacgccaaagacttcccagtatctggacaaagtggaacagccngagagtcgagacacggctaagtgttattacttgtggcgggttggcgttgggggcgggntggacgnggcggtcgggccgtaacggg

SEQ ID NO: 374346 - DNA, 604 bp, Homo sapiens
  misc_feature: GZ8MTXP01BYY04.21.19.B08.1.454.CMB.2.raw
  modified_base (368)..(368): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtaccctatagtatgaattggatccgcaggctccgaggaaggggctgcagtggctctcacagtattagtggtagtagtagttcatataattacgnagactcagtgcgagggcctattcacctatcctaccagacgaccaacgaccaaagaacttccctagtactcgtagactaaagtcggaacacgccctaggaacggagttaccggaacggtaaccgaacgggtaacttaagttgttaaacgttaccgttgggtcgggttccgggggttgggccgggttggggggaccggggtaagtcggacgacgggtccgggttcgggggaaccccgg

SEQ ID NO: 374347 - DNA, 560 bp, Homo sapiens
  misc_feature: GZ8MTXP01BB14A.21.19.B08.1.454.CMB.2.raw
  modified_base (408)..(408): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagtcctggtcaagccgtggggggtccctgagactctcctgtgcagcctctggatcccgccttcagtaccatagtatgaattggatccgccaggctccgaggaaaggggctgggagtgggctctcacagtattagtggtagtacgtagtttcatatattaacgcaagactcagtgcgaggggccattcacatctccaganacacgaccaagattccctagtatctggactaaagtcgacagcctgagacgtcgaaggacacggctaagtgttattacgttggtacgggtcgggttgggcggttgggggcggggtagtcggacggacggcggtcgggggcccgtaaccggggg

SEQ ID NO: 374348 - DNA, 530 bp, Homo sapiens
  misc_feature: GZ8MTXP01BW2HS.21.19.B08.1.454.CMB.2.raw
  modified_base (366)..(366): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcctggggggtccctgagactctcctgtgcagcctctggatccgccttcagtacctatagtatgaattggatccgcaggctccgaggaaggggctggagtggctctcacagattagtggtagtagtagtttcatatattaacgcngactcagtgcgaggggccattcaccatctcagagaacaacgccaagaacttcccagtatctggacaaagtgacagcctgagagtcgaggacacggctaagtgttattacgttgtggcgggttggcggttgggggcgggatggagtaggcgtggggccaacgggg

SEQ ID NO: 374349 - DNA, 538 bp, Homo sapiens
  misc_feature: GZ8MTXP01ACV8O.21.19.B08.1.454.CMB.2.raw
tcagtcgtcgctcgcacgaccggtgctcgatttagtgagtcagtaaggggctgagagaggagccttagccctggattccaaggcctatccacttgttgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggatcccgccttcagtacctatagtatgaattggatccgcaggctccgaggaaggggctggagtggctctcacagattagtggtagtagtagtttcattatattaacgcaagactcagtgcgagggcattcactatctccagagacaacgcaagacttcctgtatctggacaaagtcgaacagcctgagagtcgaggacacgggtctaatgttatacgttggtcggcggggttggcggttagggggcgggtatggacgcggcgtcggggccgtaaccgggg

SEQ ID NO: 374350 - DNA, 603 bp, Homo sapiens
  misc_feature: GZ8MTXP01AQ9ZB.21.19.B08.1.454.CMB.2.raw
  modified_base (364)..(364): a, c, t, g, unknown or other
  modified_base (507)..(507): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggactcccgccttcagtacctatagtatgaattggatccgcgaggctccgaagggaaaggggctgggagtggctctcacgagtattagtggtagttagttagtttnaattatattaacgcaagactcgagtgcgagggcctattccacctatcctaccgaagacgaaccaaacgcccaaaagtaacttacccgtagtaactctaggaacaaagtggaacagccgtagacggagtccgaggtacacggtntaatgttaatacgttggtgggtcgggggttcggcgggttggggggcggggtatcgggaacggtcgggccggtaacgggggaacccgtaaccggggg

SEQ ID NO: 374351 - DNA, 518 bp, Homo sapiens
  misc_feature: GZ8MTXP01EUGSS.21.19.B08.1.454.CMB.2.raw
  modified_base (361)..(361): a, c, t, g, unknown or other
  modified_base (440)..(440): a, c, t, g, unknown or other
  modified_base (471)..(471): a, c, t, g, unknown or other
  modified_base (500)..(500): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggagcctggtcaagcctggggggtccctgagactctcctgtgcagcctctggatccgccttcagtaccatagtatgaattggatccgcaggctcgaggaagggctggagtggctctcacagtattagtgtagtagtagtttcatatattaacgcngactcagtgcagggcgattcacatctccagagaacaacgccaaagtaacttccctagtatctaggcaaagtgacatccngagagtcgagacacggctaatgttattacgngtaggcgggttgcgttgggggcggatcgnaggcgtgggcgtaacggg

SEQ ID NO: 374352 - DNA, 621 bp, Homo sapiens
  misc_feature: GZ8MTXP01EBV85.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactatttagaaggtgtcagtgtgaggtgcatctggtggagtcgtgggggagcctggtcaagccgtgggggtccctgagactctcctgtgcagcctctgactcccgccttcagtacctatagtatgaattggactccgccgaggcctaccgaagggaaagggggctagggaggtggctctacgacgagtagttaggtaggttagtagttagtttacattatattaacgcaagactcgagtcgacgagggccgtattccaacctatccaccgaagacgaaacacgaccaagtaaccttcctagtactctaggactaaagtcggaacacgccgtaggaacgtacggtacggaacggtacgacgggtacttaagtttagttactttaccggttgggtcgggtcgggggttgggcgggttaggggggtcggatcgggaacgcggcgggtaacggggccgtaaccgggg

SEQ ID NO: 374353 - DNA, 528 bp, Homo sapiens
  misc_feature: GZ8MTXP01BJCAV.21.19.B08.1.454.CMB.2.raw
  modified_base (488)..(488): a, c, t, g, unknown or other
  modified_base (500)..(500): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtaccatagtatgaattggatccgccaggctcaggaaaggggctggagtggctctcacagattagtggtagtagtagtttcatatattaacgcaagactcagtgcagggcgattcacatctcagagaacaacgcaagattccctgtatctggacaaagtgacagcctgagagtcgaggacacggctaatgttattacgttgtggtcggggttggcggngggggtcggggngtggacgaggcgtcggggccgaacgggg

SEQ ID NO: 374354 - DNA, 540 bp, Homo sapiens
  misc_feature: GZ8MTXP01BUPPV.21.19.B08.1.454.CMB.2.raw
  modified_base (391)..(391): a, c, t, g, unknown or other
  modified_base (416)..(416): a, c, t, g, unknown or other
tcagtcgtcgctcgcacgaccggtgctcgatttagtgagtcagtaaggggctgggagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggatccgccaggctccagggaagggctggagtggctctcacagattagtggtagtagtacgtttcatatattacgcagctcagtgcagggcatcacatcncagagacaacgccaaagacttcccngtatcgtgacaaagtggaacagcctagagacgtcgaggacacggtctagtgtattacgtgttggcggggtgcggttgggggcgggaatggaacgaggcggttcgggggccaagggggtaacccc

SEQ ID NO: 374355 - DNA, 603 bp, Homo sapiens
  misc_feature: GZ8MTXP01ASBBR.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggactcccgccttcagtacctatagtatgaattggatccgccaggctccgaggaaggggctggagtggctctcacagtattaggtggtagtacgttagtttcagtatattaacgcaagactcagtgacgacggggcctattccactatcctaccagacgaacaacgaccaaagaacttccccagttactcctaggaccaaaagttcggaacacggcctaggacgtaacggtcgaaggaccacgggtctaagttagttaattacgttgggtcgggtcggggttcgggccggttggggggcgggtagtcgggaccgagggccgggtcgggggcccgtaacccggggg

SEQ ID NO: 374356 - DNA, 553 bp, Homo sapiens
  misc_feature: GZ8MTXP01CJV3X.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggatcccgccttcagtacctatagtatgaattggatccgcaggctccgaggaaaggggctggagtggctctcacgagattagtggtagtagttagtttcagtatattaacgcaagactcgagtgcgaggggccattccacatctaccagacacaacgcaagacttccctagtatcctaggacaaagtcggaacagccgtagagacgtcgaaggtacacggtctaagttgttattacgttgtgggcgggttggcggttgggggcgggatcggacgagcggtcggggccgaacgggg

SEQ ID NO: 374357 - DNA, 593 bp, Homo sapiens
  misc_feature: GZ8MTXP01A1ITZ.21.19.B08.1.454.CMB.2.raw
  modified_base (362)..(362): a, c, t, g, unknown or other
  modified_base (373)..(373): a, c, t, g, unknown or other
  modified_base (375)..(375): a, c, t, g, unknown or other
  modified_base (491)..(491): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggactcccgccttcagtacctatagtatgtaatggactccgcaggctaccgaaggaaggggcgtaggagtggctctcacgagtattagtggtagtagttagtttnatatattaacncnactcgagtgacgagggctattccacatcgtaccagacgaaccaacgccaaagtacttcctgtactcgtaggacaaagtggaacacgtccgtagacgaggtcgaacggacaccggtntaatggttaacttacgttgggtcgggtaccgggggttggttccgggttggggggaagggtagtcgggaaccggcgggccgggtcggggaaccgtaaccgggg

SEQ ID NO: 374358 - DNA, 554 bp, Homo sapiens
  misc_feature: GZ8MTXP01DV6GJ.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagcctgggggtccctgagactctcctgtgcagcctctggatccgccttcagtaccatagtatgaattggatccgccaggctccgaggaaaggggctggagtggctctcacagattagtggtagtagtagtttcatatattaacgcaagactcagtgcacggggccctattcaccatcctccagagaacaaccgaccaaagaacttcccctgtaactcgtaggacctaaatcgggaacagccctggagagtcggagacacggctaatgttattacgttggtagtcggggttggcggttgggggcgggatggacgcggcgtcggggccgaaccgggg

SEQ ID NO: 374359 - DNA, 667 bp, Homo sapiens
  misc_feature: GZ8MTXP01BD19R.21.19.B08.1.454.CMB.2.raw
  modified_base (618)..(618): a, c, t, g, unknown or other
tcagtcgtcgctcgcacgaccggtgctcgatttagtgagtcagtaagggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtggggagcctggtcaagccgtgggggtccctgagactctcctgtgcagcctctggactcccgccttcacgtacctatagtatgtaattggatccgcaggctccgaaggaagggcgtaggagtcggctctcacgagtagttagtggtagtagttagtttacatatattaacgctaagactcgagtcgacgacgggctatccaacctattccgaccaagacgaaaccaaaccgacctaaagtaccctttacccctaggttaacttacccgtagggtaaacccgtaaaagttaccggggaaacctaaggaccccgttaggaacggtaaacggttacggaaacgggaccgtacgggtacttaagttagttaacgtttacgttggtacgggtcgggggttaccgggttgggttacgggggngggggtatcggacgggaggccgggttcgggggaaccgttaacccggggg

SEQ ID NO: 374360 - DNA, 561 bp, Homo sapiens
  misc_feature: GZ8MTXP01CHHAX.21.19.B08.1.454.CMB.2.raw
  modified_base (534)..(534): a, c, t, g, unknown or other
  modified_base (541)..(541): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactatttagaaggtgtccagtgtgaggtgcatctggtggagtcgtgggggaggcctggtcaagccgtgggggtccctgagactctcctgtgcagcctctggactccgccttcagtaccatagtatgaattggactccgcaggctaccgaggaaggggctggagtggctctcacgagtattagtggtagtacgtagttacattatattaacgcaagtactcgagtgcaggggccattcccactatcaccagacgaacaaccgcaaagacttccctagtactctaggggactaaagtcggacagtccagagacgtcgaagacacggtctaatgttaattacgttggtaggcggggttcgcgggttgggggcggggtancggacgnggcggtcgggccgtaacggg

SEQ ID NO: 374361 - DNA, 569 bp, Homo sapiens
  misc_feature: GZ8MTXP01ECE3M.21.19.B08.1.454.CMB.2.raw
  modified_base (493)..(493): a, c, t, g, unknown or other
  modified_base (499)..(499): a, c, t, g, unknown or other
  modified_base (542)..(542): a, c, t, g, unknown or other
  modified_base (548)..(548): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactatttagaaggtgtccagtgtgaggtgcatctggtggagtcgtgggggagcctggtcaagcgttgggggtcctgagactctcctgtgcagcctctggactccgccttcagtacctatagtatgaatggatccgcaggctacgaggaaggggctggagtggctctcacagtattaggtggtagttagtagtttacaatatattaacgcaagactacagtcgacgacggggctattccactatctaccaagaacgaacaaaccgacaaacgtacttcccagttactacgtaggaactaaagtcggaactagccctagaggagtcgaggacacggntaagtnttattacgttggtgggcgggttgggcggttgggggcgggtagnggacgnggcggtcggggaaccgaacgg

SEQ ID NO: 374362 - DNA, 621 bp, Homo sapiens
  misc_feature: GZ8MTXP01EMNDL.21.19.B08.1.454.CMB.2.raw
  modified_base (270)..(270): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggatcccgccttnagtacctatagtatgaattggatccgcaggctaccgaggaaggggctggagtggctctcacagtattaggtggtagtagttagtttcaagttaatagttaaacgctaagactcgagttcgacgagggggacctagtttacccaccaattcctacccgaaggaacgaaacgaaaccggtaccaaaagtaacttacccctaggtaactcgttagacaaaagtggaaccagccgtagacgagtcggaaggtaccacgggtctaagtgttaacttacgttggtacgggtccgggttggcggttcgggggcgggatcggaccggtaggccggtaacggggccggtaaacccggggg

SEQ ID NO: 374363 - DNA, 624 bp, Homo sapiens
  misc_feature: GZ8MTXP01CTDM7.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatcgtggtggagtcgtgggggaggccgtggtcaagccgtgggggtccctgagactctcctgtgcagcctcgtggactcccgccttcagtacctatagtatgaattggactccgcaggcctaccgaaggaaaggggctggagtcggctctcacagtagttaggtggtagtagttagtttacattaatataacgcaagactgagtgacgacgggctacttcaactatcctacgagaacgacaacgaccaaagtacttccctgtactcgagggaactaaagtcggaacaggtcccgtaggagtaacggcggtaacggacccgtacggtcttaagttcgttaacgtttacgttgggtacggggccggggttaggggcgggttacggggggaacgggtatcggaacggtggcgggtaaccggggaaccgtaaccggggg

SEQ ID NO: 374364 - DNA, 565 bp, Homo sapiens
  misc_feature: GZ8MTXP01DSYKA.21.19.B08.1.454.CMB.2.raw
  modified_base (342)..(342): a, c, t, g, unknown or other
  modified_base (357)..(357): a, c, t, g, unknown or other
  modified_base (372)..(372): a, c, t, g, unknown or other
  modified_base (470)..(470): a, c, t, g, unknown or other
  modified_base (555)..(555): a, c, t, g, unknown or other
  modified_base (559)..(559): a, c, t, g, unknown or other
  modified_base (561)..(563): a, c, t, g, unknown or other
  modified_base (565)..(565): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggatccgccttcagtacctatagtatgaattggatccgtcaggctccgaggaaagggggctggagtggctctcacagattaggnggtagtagtagtttnattatacttaacgcngactcaagtgacgacggggccgtattccaaccatcctaccaagacgaactaacgaccaaagtaacttccctagtactctgggactaaaagtcgaacanccgtgaggtaacgtcggaaggacctacgggcttaaagtggttaattaccgttaggaggtcgggggcttacgggaccgaagggccngaangnnngn

SEQ ID NO: 374365 - DNA, 577 bp, Homo sapiens
  misc_feature: GZ8MTXP01EV5CF.21.19.B08.1.454.CMB.2.raw
  modified_base (556)..(556): a, c, t, g, unknown or other
tcagtcgtcgctcgcacgaccggtgctcgatttagtgagtcagtaaggggctgagagaggagccttagccctggattccaaggcctatccacttggtgatcagcaatgagcaccgaggattcaccatggaactgggctccgctggttttcctagttactatttagaaggtgtccagtgtgaggtgcatctggtggagtcgtgggggagcctggtcaagccgtgggggtccctgagactctcctgtgcagcctctggactcccgccttcagtaccatagtatgaattggatccgcaggctccgaggaaaggggctggagtggctctcacagtattagtggtagtagtagtttcatatataacgcaagtactcagtgcgagggccattccacatctaccagacgaacaacgaccaaagtaacttcccctagtaactctacggactaaagtcgggaacagtccctaggtagacgtcggaacggaccgacggcttaatgtttaattacgttgggtgggtcggggttgggttccggttggggggcggggatcgggaacggngggcggtcggggccgaacggg

SEQ ID NO: 374366 - DNA, 624 bp, Homo sapiens
  misc_feature: GZ8MTXP01ELAG5.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggatcccgcttcagtacctatagtatgaattggactccgcaggctccgaggaaggggctggagtggctctcgacagtattagtggtagtacgtagtttcaattatattaacgcaagtactacgagtcgcgacggggccgtattcccaactatcctaccaagaacgaaccaaacggaccaaagtaacttccccgtatactacctagggactaaaatcgggaaccagtcccgtaggaacgacggtccggaaaggacctacgggcttaagttagttacttacgttggtgggtccggggttggccgggttggggggaacggggtattgggaacccgtgggccggttcggggggaacccgtaaaccggggg

SEQ ID NO: 374367 - DNA, 565 bp, Homo sapiens
  misc_feature: GZ8MTXP01AKQLJ.21.19.B08.1.454.CMB.2.raw
  modified_base (504)..(504): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtaccatagtatgaattggatccgccaggctccgaggaaggggctggagtggctctcacagtattagtggtagtagtagtttcatatataacgcaagactcagtgacgaggggccgattcaccatcctccagagaaccaacgaccaaagtaacttcccctagtaactcctagggaccaaagtcggaacagcccgtgaacgtagtcgaaggacgacggctaatgttattacgnggtggtccgggttggttcggttgggggcgggatggacgaggcgtcggggccgtaaccgggg

SEQ ID NO: 374368 - DNA, 544 bp, Homo sapiens
  misc_feature: GZ8MTXP01D401R.21.19.B08.1.454.CMB.2.raw
  modified_base (254)..(254): a, c, t, g, unknown or other
  modified_base (368)..(368): a, c, t, g, unknown or other
  modified_base (394)..(394): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactatttagaaggtgtccagtgtgaggtgcatctggtggagtcgtgggggagcctggtcaagccgtgggggtccctgagactctcctgtgcagcctntggatccgccttcagtacctatagtatgaattggatccgcaggctcgaggaaggggctggagtggctcgtcacgagtattaggtggtagttagtagtttcaatatattaacgcngactcagtgcaggggcattcacatcncagagacaacgcaagaactccctgtaatcagacaaatggaacagcctgagacgtgaaggtacacggtctaagtgttattacgttgtacggtcggggttggttcggttcgggggcgggtatggaccgagggcgtcgggggccgaaccgggg

SEQ ID NO: 374369 - DNA, 547 bp, Homo sapiens
  misc_feature: GZ8MTXP01AYHWR.21.19.B08.1.454.CMB.2.raw
  modified_base (368)..(368): a, c, t, g, unknown or other
  modified_base (487)..(487): a, c, t, g, unknown or other
  modified_base (525)..(525): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcgttggggggtccctgagactctcctgtgcagcctctggatcccgccttcagtaccatagtatgaattggatccgcaggctcgaggaaggggctggagtggctctcacagattaggtggtagtagtagtttcagtatattaacgcngactcagtgcagggcatcacatctcagagacaacgccaagaacttcccgtagtactctagggactaaaagtcgggacacgccgtagagagtcgaggacacgggctaagtgttattacgngtcggtcgggttggcgttgggggcgggtatcggaacgnggcggtcgggaaccgtaacggg

SEQ ID NO: 374370 - DNA, 632 bp, Homo sapiens
  misc_feature: GZ8MTXP01BB5F1.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggactcccgccttcacgtacctatagtatgaattggactccgccaggcctccgaagggaaggggctgggagtggctctcacagtattaggtggtagtagttagtttcagtatattaacgcaagactacgagtcgacgacggggccgtattccacctagtacctccaagagaaccaacggaccaaagtaccttcccagttaactcgtaggactaaaagtcgggaactaggccctagacggtacgtcggaagggaccacgggtctaagttcgttaagtttacgttgggtagggtccgggggttggccggggttggggggaaccgggtagtaacgggacggacgggttacgggtcggggggaacccgtaaaccggggg

SEQ ID NO: 374371 - DNA, 562 bp, Homo sapiens
  misc_feature: GZ8MTXP01AV9X3.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgcaggctccgaggaaagggggctgggagtgggctctcacgagattaggtggtagtagttagtttcatatattaacgcaagactcagtgcgagggcattcacatctaccagacacacgaccaagtacttccctagtactcgtaggacaaagtcggaacagccgtagagacgtacgaggaccacggctaagtgttatacgttggtaggtccggggttggcgggttacgggggcggtagtccggaagcgggcggtcgggcggaaccggg

SEQ ID NO: 374372 - DNA, 548 bp, Homo sapiens
  misc_feature: GZ8MTXP01BUOB0.21.19.B08.1.454.CMB.2.raw
  modified_base (424)..(424): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtaccctatagtatgaaattggatccgccaggctccaggaaaggggctggagtggctctcacagattagtgtagtagtagtttcatatattaacgcaagactcagtgcaggggccattcacatctccagagacaacgccaaagacttcccngtactctggacaaagtgacagcctgagagtcgaggacacggctaatgttaattacttggtacggcggggttgggcggttgggggccgggagtcggacagggcgtaacgggggcgtaaccggggg

SEQ ID NO: 374373 - DNA, 713 bp, Homo sapiens
  misc_feature: GZ8MTXP01CLVFF.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaacgtggggctccgcgttgggttttcctagttacttattttagaaggtgtcagtgtgaggtgcatcgtggtggagtcggtgggggaggccgtggtcaacggccggttcggggggtccctggagtacctctcctgtgcacgcctcgtggactcccgtccttacacgtacctatagtatagtaagttggactccgcgacggcctaccggaaggggaaaggggcgtagggagtcgggcctctacacgtagtagttaggtaggttagttagttagtttacaattataacttaacgactaagtactacgaggtcgacgacggggtcctacttacccaactactccctacgaagacgaaaccgaaccgacctaaagtacccttacccgtagtacttacgcggaaacgtaaagtcggaaccgtacgtccgtagggaagtaaccggtcgggaacggtaaccgtacgggtacttaagttacggttactttaccggttggggtacggggtccgggggttacgggcggggttacggggggtaacgggagtcgggaacgcggggttaccgggtccgggggaacccgtaaccggggg

SEQ ID NO: 374374 - DNA, 602 bp, Homo sapiens
  misc_feature: GZ8MTXP01DCT8S.21.19.B08.1.454.CMB.2.raw
  modified_base (372)..(372): a, c, t, g, unknown or other
  modified_base (595)..(595): a, c, t, g, unknown or other
  modified_base (599)..(599): a, c, t, g, unknown or other
  modified_base (601)..(601): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtggggggaggcctgggtcaagccgtggggggtccctgagactctcctgtgcagcctctggactccgccttcagtacctatagtatgaattggatccgcaggctccgaggaaaggggctggagtggctctcacagtattagtggtagtagtagtttcatatattaacgcngactcagtgcgaggggcattcacatctacagagaacaacgcaaagtacttccctagtatcctaggacctaaaagttacgggaaccaggccccgttaggaacggtaacggtacggaaacgggaaccgaaccgggtacctaagttagttaaacgtttaaccgttgggaaacgggtccggggaccgttggggacccgtaaaaggggcccgtaacggtaaagtaggngtgngng

SEQ ID NO: 374375 - DNA, 555 bp, Homo sapiens
  misc_feature: GZ8MTXP01CJKGG.21.19.B08.1.454.CMB.2.raw
  modified_base (462)..(462): a, c, t, g, unknown or other
  modified_base (485)..(485): a, c, t, g, unknown or other
  modified_base (509)..(509): a, c, t, g, unknown or other
  modified_base (525)..(525): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggactcccgtcttcagtacctatagtatgaattggatccgcaggctccgaggaaggggctggagtcggctctcacgagtattaggtggtagtagttagtttcagttatattaacgcaagctagagtgcgaggggccattccacctatctaccgagacaacaaccgaccaaagaacttcccagtactactggactaaagcgaacngccgtgagcgtacgagacacggntaatgttatcgttgtcgggtgggnggcggttgggggcggngtgacgaggcggtcggggccgtaaccgggg

SEQ ID NO: 374376 - DNA, 538 bp, Homo sapiens
  misc_feature: GZ8MTXP01AT253.21.19.B08.1.454.CMB.2.raw
  modified_base (359)..(359): a, c, t, g, unknown or other
  modified_base (372)..(372): a, c, t, g, unknown or other
  modified_base (397)..(397): a, c, t, g, unknown or other
  modified_base (481)..(481): a, c, t, g, unknown or other
  modified_base (530)..(530): a, c, t, g, unknown or other
  modified_base (535)..(538): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggactcccgccttcagtacctatagtatgaattggactccgcaggctccgaggaaggggctggagtggctctcacgagtattaggtggtagtagtagtttnatatattaacgcngactcagtgcagggcattcacatcncagagacaacgcaaagtacttccctagtactctaggactaaagtcggaacagccgtggaacgacggtacgaaggtacacgggtntaagtgttaatacgttaggacggcgggttcgttgggaccgaaggcgaanagtgnnnn

SEQ ID NO: 374377 - DNA, 552 bp, Homo sapiens
  misc_feature: GZ8MTXP01EB7K6.21.19.B08.1.454.CMB.2.raw
  modified_base (360)..(360): a, c, t, g, unknown or other
  modified_base (379)..(379): a, c, t, g, unknown or other
  modified_base (383)..(383): a, c, t, g, unknown or other
  modified_base (429)..(429): a, c, t, g, unknown or other
  modified_base (450)..(450): a, c, t, g, unknown or other
  modified_base (530)..(530): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggagcctggtcaagccgtgggggtccctgagactctcctgtgcagcctctggactccgccttcagtacctatagtatgaaattggactccgccaggctaccgaggaaaggggctaggagtggctctcacagtattagtggtagtacgttgttanatatattaacgcaagactnagtncgagggcgattcacatctacagagaacaacgaccaaagacttcccngtactctggacaaagtgaacngacctgagacggtcgaagggacctaggctaatgttattacgttgtcggtcgggttgggcgttgggggcgggtagcgacgnggcgtcggggccgtaaccgggg

SEQ ID NO: 374378 - DNA, 586 bp, Homo sapiens
  misc_feature: GZ8MTXP01A3W1Q.21.19.B08.1.454.CMB.2.raw
  modified_base (511)..(511): a, c, t, g, unknown or other
  modified_base (557)..(557): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggactcccgcttcagtacctatagtatgaattggactcccgcaggctaccgaagggaaggggctggagtggctctcacagtattaggtggtagttagttagtttcatatataacgcaagactcgagtgcgacgggctacttccactatccacagacaaccaacgcaaagtaccttccctagtactcacggaactaaagtcggaacacgcctaggagacggtgaacggccacgggtctaagtgttacttacggnggtcgggtcggggttgggcgggttggggggcgggaatcgggaacgnggttccggtcgggggaaccctaacggggg

SEQ ID NO: 374379 - DNA, 798 bp, Homo sapiens
  misc_feature: GZ8MTXP01AGVNZ.21.19.B08.1.454.CMB.2.raw
  modified_base (684)..(684): a, c, t, g, unknown or other
  modified_base (702)..(702): a, c, t, g, unknown or other
tcagtcgtcgctcgcacgaccggtgctcgatttagtgagtcagtaagggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggagcctggtcaagccgtgggggtccctgacgacctctcgtgtcgcacgtctcggtcgacgtcctctacgtacgtactagtagtatagtagtgtacgtcccgacgacgtcctaccggaaggggaacggcgtggacggtcgtcgtctacagtagtagttggtaggttagttagttcgttatattaacttacgtaaccgacgtaacgtactacggtagtacggacgggaccggggtaccttaactaccccaacgttacttcccgaaacccggaagaaaccggtaaaaccccgaaaccgtaacccgggttaaaagtttaccccctttcccgtaaggtttaccttaccggtacggtaaaacgtaacgggttaccggaaacccgtttaccgggtaccgtaaagggaccggttaaccgggacggggaaaaccggtaccggtaaacccggtttgtaaaccgggtttagtttaaacccggtttcggngggggttaacccgggggngggggtttcccggggttgggggacccggggggtaagttacggaacccgggaaggtcccggggttcgggtccgggggaacccgggttaaccccgggg

SEQ ID NO: 374380 - DNA, 554 bp, Homo sapiens
  misc_feature: GZ8MTXP01BLMW1.21.19.B08.1.454.CMB.2.raw
  modified_base (448)..(448): a, c, t, g, unknown or other
  modified_base (454)..(454): a, c, t, g, unknown or other
  modified_base (491)..(491): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatcgtggtggagtcgtgggggagcctggtcaagccgtgggggtccctgagtactctcctgtgcagcctcgtggactcccgtccttcacgtacctatagtatgaattggactccgcagctacgaagggaagggctggagtggctctcacgagtattagtggtagtagttagttcatatataacgctgactgagtgcgacgggctatccatatccacaagacgaacacgacaagtaccttccagtactctaggactaaagngaaccngtccaggagagtcgaggacaggtctaagtgttactgnggagggtcgggttggcgggttgggggcggtatcggacgtgggcgggtcgggccgtaaccgggg

SEQ ID NO: 374381 - DNA, 575 bp, Homo sapiens
  misc_feature: GZ8MTXP01CB570.21.19.B08.1.454.CMB.2.raw
  modified_base (372)..(372): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtaccatagtatgaattggatccgcaggctccgaggaaaggggctgggagtggctctcacgagattagtggtagtagttagtttcattatattaacgcngactcagtgcgagggcattccacatctccagacgaacaacgccaaagtaacttcccgtagtactctagggactaaaagtcgggactacgcctaggagagtcggaaggacgacggtctaagtgttattacgttggtcgggtcggggttggcggttcggggggcgggtatgggacgtagggcggtcgggggcccgtaaccggggg

SEQ ID NO: 374382 - DNA, 556 bp, Homo sapiens
  misc_feature: GZ8MTXP01B6C8M.21.19.B08.1.454.CMB.2.raw
  modified_base (351)..(351): a, c, t, g, unknown or other
  modified_base (525)..(525): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggatcccgcttcagtaccatagtatgaattggatccgcaggctccgaggaagggctggagtggctctcacagtattagtggtagtagtagtttnatatattaacgcaagactcgagtgcgtaggggcctattcacatctacagagaacaacgacaagtaacttaccctgtactctaggactaaagtcgaacagcctagagagtcgaggacgacggctaatgttaaaattcgttaggtggtcgggttgggttcggttcgggggcggggngtggacgaggcggtcggggccgtaaccgggg

SEQ ID NO: 374383 - DNA, 622 bp, Homo sapiens
  misc_feature: GZ8MTXP01BNVJN.21.19.B08.1.454.CMB.2.raw
  modified_base (488)..(488): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactcccgcttcagtacctatagtatgaattggactccggccaggctaccgaagggaagggggctgggagtggctctcacgagtagttaggtggtagtaggttagtttcatattattaacgcaagactcgaggtgcgacggggcctacttccacctatcctaccaagacgaaccaaccggtaccaaagtaaccttcccctagttaactctaggactaaagtggaaccnggtaccctggaggtacgtacggaaggaccacgggtcttaagtggttattaccgttgggtcgggtcgggggttcgggttcgggttggggggaacggggagtcggaggacgggcggtcggggcccggaaccggggg

SEQ ID NO: 374384 - DNA, 668 bp, Homo sapiens
  misc_feature: GZ8MTXP01ECCDD.21.19.B08.1.454.CMB.2.raw
  modified_base (371)..(371): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggactccgcagctccgaggaaggggctggagtggctctacacagtattagtggtagttagttagtttcatatattaacgnaagtactcagtgacgaggggccgtattccacctatcctacagacgaaccaaacgaccaaacgtaacttcccctagtactctagggacctaaagttcgggaacacggacccgttaggaaggtaacggtacggaaagggacccgtaacgggtccttaaagttcgttaaagtttaaccgttggggtacggggtccggggggttgggccgggggttggggggggaaccgggggtagttaacggggtaacggacggggttaccggggttaaccggggggaaccccgggtaaaccccgggggg

SEQ ID NO: 374385 - DNA, 601 bp, Homo sapiens
  misc_feature: GZ8MTXP01BO0XK.21.19.B08.1.454.CMB.2.raw
  modified_base (373)..(373): a, c, t, g, unknown or other
  modified_base (384)..(384): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaaggccgtgggggtccctgagactctcctgtgcagcctctggactccgccttcagtaccatagtatgaatggactccgcaggctccgaggaagggggctggagtggctctcacagtattaggtggtagtagttagtttacattatattaacgcngactcgagtgnacggggcctattcaccatcctacccgaagtacgaaccgtaaccgaccaaacgtaacttcccctgttactcgtaggactaaagtcgggaaccagtccgtaggacggacggtcggaacgggaaccgacgggtctaagtcgttagttacgttggtcgggcggggttgggcgggttgggggaacggggagtcgacggaggcgggtcgggcggtaaccgggg

SEQ ID NO: 374386 - DNA, 631 bp, Homo sapiens
  misc_feature: GZ8MTXP01A5Z0I.21.19.B08.1.454.CMB.2.raw
  modified_base (380)..(380): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatctggtggagtcgtgggggagcctggtcaagccgtgggggtccctgagactctcctgtgcagcctctggactcccgccttcagtacctatagtatagaattggactccgcaggctaccgagggaaggggctaggagtggctctcacgagtagttaggtggtagttagttagtttacaagtatataacgnaagactcgagtgacgacggggacctattaccgacctactctcccaagacgacaaccgaccaaagacttccctagtactcgtaggaacctaaagtcggacacgtccgtagaagtacgggtacgaacgggaacgaccgggtctaagttcggttattaccggttggtacggggtcggggttagggttccgggttggggggtaagggcgtaacggaacggtcggttccggtaacgggggaaccgtaacccggggg

SEQ ID NO: 374387 - DNA, 630 bp, Homo sapiens
  misc_feature: GZ8MTXP01CD3GH.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaaggccgtggggggtccctgagactctcctgtgcagcctcgtggactcccgcttcagtacctatagtatgtaatggactccgcaggctacgaaggaagggctggagtggctctacacagtattaggtggttagttacgttagtttacatttatacttaacgacaagtactacgaggtcggcgacgggggtccctattccgaacctactctacccaagaacgaaccaaaccgtaccaagtaacttcccctagtacttcgttaggactaaagtcggacagtccgtagaggacgtcggagacgacggcttaagtcgttaagttacgttggtacgggtcggggttgggttccgggttagggggtcggggtagttcggacggacgggttacgggtccggggaaccggtaaccggggg

SEQ ID NO: 374388 - DNA, 630 bp, Homo sapiens
  misc_feature: GZ8MTXP01BL5CK.21.19.B08.1.454.CMB.2.raw
  modified_base (364)..(364): a, c, t, g, unknown or other
  modified_base (605)..(605): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctgggtggagtcgtgggggaggcctggtcaagccgtgggggtccctgagactctcctgtgcagcctcgtggactcccgtccttcacgtacctatagtatagaattgactccgccaggctaccgaggaaggggcgtggagtggctctacacagtattagtggtagtagtgttanatatattaacgacaagtactcgagtcgacgtacgggcgtacttccacctattccaacccgaaggaacgtaaccaaacgacctaaagtaaccttcccgtagttactcgtagaactaaagtcggaacacgccgtaagaggaacggtcgaacgggactacgggtcttaaggttcgttaaagttcgttagggtgggtacccgggggttgggcggttacggggggaacggggtatcggaaccgggngggcgggtcggggaaccgtaacggg

SEQ ID NO: 374389 - DNA, 557 bp, Homo sapiens
  misc_feature: GZ8MTXP01BT9T1.21.19.B08.1.454.CMB.2.raw
  modified_base (367)..(367): a, c, t, g, unknown or other
  modified_base (502)..(502): a, c, t, g, unknown or other
  modified_base (536)..(536): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggatccgcaggctccgaggaaaggtctggagtggctctcacagattagtggtagtagtagtttcatatattaacgnaagactcgagtcgcgacgggggcctattccacctatctaccagaacgaaccaaacgccaaagtaacttcccctagtaactctaggacaaagtggaacagcctgagagtcgaggacacggctaagtgttattacgngtggcgggttggcggttgggggcgggatggacgnggcgtcgggggcctaacgggg

SEQ ID NO: 374390 - DNA, 632 bp, Homo sapiens
  misc_feature: GZ8MTXP01EWUA2.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtcagtgtgaggtgcatctggtggagtcgtggggagcctggtcaagccgtgggggtccctgagactctcctgtgcagcctctggactcccgccttcagtacctatagtatagaattggactccgcaggctccgaggaaggggctggagtggctctcacgagtagttaggtggtagtagttagtttacattatacttaacgcaacgtactcgagtgacgacggggcctattccaacgtattccacgagaacgaacaacgaccaaagtaacttccctagtaactcgtaggaactaaagtcggaacacgtccgtagacgtacggtacgaaggacaacgggtctaagtttcgttaaattacgttgggtacgggtcgggggttacgggcgggttaggggggggcggggtattaacggggacccgaggggttccgggttaacgggggaacccgtaaacccggggg

SEQ ID NO: 374391 - DNA, 545 bp, Homo sapiens
  misc_feature: GZ8MTXP01CYEKW.21.19.B08.1.454.CMB.2.raw
  modified_base (367)..(367): a, c, t, g, unknown or other
  modified_base (385)..(385): a, c, t, g, unknown or other
  modified_base (443)..(443): a, c, t, g, unknown or other
  modified_base (457)..(457): a, c, t, g, unknown or other
  modified_base (476)..(476): a, c, t, g, unknown or other
  modified_base (480)..(480): a, c, t, g, unknown or other
  modified_base (496)..(496): a, c, t, g, unknown or other
  modified_base (517)..(517): a, c, t, g, unknown or other
  modified_base (522)..(522): a, c, t, g, unknown or other
  modified_base (524)..(525): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggactcccgtccttcagtaccctatagtatgaattggactcccgcgaggcctccgaagggaaagggggctggagtcggctctcacagtattagtggtagtagttagttnatatattaacgcaagctnagtgcgaggggccattcacatctcagacgacaccgaccaaagtacttcctagtactcngacaaatcggaacncgctgagacgtcgaggacncggntaagtcgttaattcgnggtgcggggttggttcggggnggggngnngagcgcggtcggcgtaacgg

SEQ ID NO: 374392 - DNA, 536 bp, Homo sapiens
  misc_feature: GZ8MTXP01CUQBR.21.19.B08.1.454.CMB.2.raw
  modified_base (324)..(324): a, c, t, g, unknown or other
  modified_base (348)..(348): a, c, t, g, unknown or other
  modified_base (360)..(361): a, c, t, g, unknown or other
  modified_base (366)..(366): a, c, t, g, unknown or other
  modified_base (369)..(369): a, c, t, g, unknown or other
  modified_base (499)..(499): a, c, t, g, unknown or other
  modified_base (502)..(502): a, c, t, g, unknown or other
  modified_base (505)..(505): a, c, t, g, unknown or other
  modified_base (510)..(510): a, c, t, g, unknown or other
  modified_base (514)..(514): a, c, t, g, unknown or other
  modified_base (516)..(516): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactatttagaagtgtccagtgtgaggtgcatctggtggagtcgtggggagcctggtcaagcctggggggtcctgagactctcctgtgcagcctctggatccgcttcgataccatagtatgaattggatccgccaggctacgaggaaagggctggagtggctctcanagattagtggtagtagtagtttanatatactaacgnngacanagngcgacggactactacacactacacgacgacgaacgaacgaacaacgtaacttacctactactactacgaacaaagacgacgacgcgtagagacgacgacgacgacgataatagttagtagttgtggtggnggnggnggggngggngngagagcggtcggcggaacgg

SEQ ID NO: 374393 - DNA, 644 bp, Homo sapiens
  misc_feature: GZ8MTXP01AN81Y.21.19.B08.1.454.CMB.2.raw
  modified_base (246)..(246): a, c, t, g, unknown or other
  modified_base (574)..(574): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctggttttcctagttactatttagaagtgtccagtgtgaggtgcatctggtggagtcgtggggaggcctggtcaagccgtgggggtcctgagactctcctgtgcngctctggactccgccttcagtacctatagtatagtattggactcccgccgaggcctaccgaggaaaggggctggagtcggctctacacgagtattaggtggttagtagttagtttactagtatattaacgacaagactcgagtcgacgagggccgtattcccaacctactaccaccgaagacgaacccaaaccgacctaaagtacctttaccccgtagtactttacccgtaggggaacctaaaaggttcggaaaccgacggtacccgttagggaaaggtacggtacgaaacggggtaaccgccgggtattaaggttgttacgtttacnggggtcggcggggttggcgggttggggggaacgggtatgggaactggggccgtcgggggccgaaccgggg

SEQ ID NO: 374394 - DNA, 599 bp, Homo sapiens
  misc_feature: GZ8MTXP01A3RKF.21.19.B08.1.454.CMB.2.raw
  modified_base (469)..(469): a, c, t, g, unknown or other
  modified_base (525)..(525): a, c, t, g, unknown or other
  modified_base (563)..(563): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggatcccgccttcagtaccatagtatgaattggatccgcaggctccgaggaaggggctggagtggctctcacagattagtggtagtacgttagttacatatacgttaacgcaagactcagtgcgacgggccgacttccgaaccatcctaccagaacgacaaacgccaaagtaacttccccgtagtaactccagggactaaagtcgggaacncgaccctaggacgtaggtccggaagggtacccagggtcctaagtgttaacttacgnggtcgggcggggttcgggccgttggggggaacgggttncgggacgtgggccggttgggggaaccgtaaccgggg

SEQ ID NO: 374395 - DNA, 592 bp, Homo sapiens
  misc_feature: GZ8MTXP01DV940.21.19.B08.1.454.CMB.2.raw
  modified_base (409)..(409): a, c, t, g, unknown or other
  modified_base (470)..(470): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgagtgcatctggtggagtcgtgggggagcctggtcaagccgtgggggtccctgagactctcctgtgcagcctctggatcccggccttcaagtacctatagtatgtaattggactccgcaggctaccgaaggaaggggctggagtcggctctcacagtattagtggtagtagttagttacattatattaacgcaagactcagtcgcgaggggcctattcccaaccgtnttccaccaagacgaacaaccgcaaagtacttcccagtaatccagggactaaagtcggaacngcctaggacgaagtcggaaagtaccgacggtctaagttgttattacgttggtagggcgggttggcgggttcgggggaagggtgtaacgacggacggttacggtcgggaaccgtaacccgggg

SEQ ID NO: 374396 - DNA, 586 bp, Homo sapiens
  misc_feature: GZ8MTXP01DLNZC.21.19.B08.1.454.CMB.2.raw
  modified_base (375)..(375): a, c, t, g, unknown or other
  modified_base (505)..(505): a, c, t, g, unknown or other
  modified_base (521)..(521): a, c, t, g, unknown or other
  modified_base (563)..(563): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggactcccgccttcagtacctatagtatgaattggactccgcaggctcgaaggaaggggctaggagtggctctacacgagtattaggtggtagttagtagtttacatatattaacganaagactcagtgacgagggaccgtattccacctatacctaccgaagaacgaacaacgacctaaagtaccttcccgtagtaactcgtaggaacaaagtcggacagcctaggagacggtcgaaggacacggtntaagtgttaattacgnggtcgggcggggttaggcggttagggggcggtatcggaacgngggcgtcggggccgtaaccgggg

SEQ ID NO: 374397 - DNA, 637 bp, Homo sapiens
  misc_feature: GZ8MTXP01AK2JU.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactcccgccttcagttacctatagtatgaattggatccgcaggctccgaggaaaggggctggagtcggctctcacagtattaggtggtagtagtagtttcatatagttaacgctaagactcgagtcgacgaggggcctattccaccatcctaccgaagagaacaaccgccgaaaagtacttcccgtagtactcgtagggacaaagtcggaacgagtcccgtaggagtacggccggaggaacccacgggtcttaagttcgttaagttaaccggttgggcgggtcgggggttcggttcgggggttaccggggggtaacgggggaattggggaaccccgtaggggacccggttcggggggaacccgtaaaccccggggg

SEQ ID NO: 374398 - DNA, 546 bp, Homo sapiens
  misc_feature: GZ8MTXP01DNA6Y.21.19.B08.1.454.CMB.2.raw
  modified_base (473)..(473): a, c, t, g, unknown or other
  modified_base (487)..(487): a, c, t, g, unknown or other
  modified_base (517)..(517): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaaggccgtggggggtccctgagactctcctgtgcagcctctggatccgcttcagtacctatagtatgaattggatccgcaggctcgaggaaaggggctggagtggctctcacagattagtggtagtagttagttcatatattaacgcaagactcagtgcgagggccaattcaccatctccagagaacaacgaccaagtaacttccctagtatcctggacaaatggaacagcctgagtaggtcgaagacaccggntaagtgttacttanggtcgcggggttggcggttggggcgggggntcggacgaggcggtcggggccgaacgggg

SEQ ID NO: 374399 - DNA, 709 bp, Homo sapiens
  misc_feature: GZ8MTXP01E1LHM.21.19.B08.1.454.CMB.2.raw
  modified_base (344)..(344): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaaggccgtgggggactccctgacgactctcctgtgcagcctcgtggactccgccttcagtacctatagtatagtaattggactccgacacggctaccgaagggaaaggggctggagtggctctcanagtattaggtggtagttagttagtttcatataaacttacgctaagactacaggtcgacgacgggacctacttaccaaccgtaacttccaaccgaaggtaaaccgaaccgaaaccggacccaaacggttaacctttacccctagttaaccttacggtaacgaacgtaaaacgtcggggaaaccacggtaccgttagaacgggtaacgtccgggaacggaacccgaacgggtctttaagttacggttaacgttttaaccggtgggttcggggttccggggggttggggacggggttaacggggggggaccggggtaaggtaacgggtaccgggacggggtcccggggttaacggggggaaccccggg

SEQ ID NO: 374400 - DNA, 668 bp, Homo sapiens
  misc_feature: GZ8MTXP01CMYM8.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactatttagaaggtgtccagtgtgaggtgcatctggtggagtcgtgggggaggcctggtcaagccgtgggggtccctgagactctcctgtgcagcctcgtggactcccgccttcaacgtacctatagtatagtaattggactccgccaggctaccgaagggaaacgggggcgtaggagtggctcgtacacgagtattaggtggtagttagttagtttacattaatattaacgcaagactcgaggtgcgaggggccgtattcccactattccaccgaagaacgaacaaaccgacaaagtaaccttccctagtacttccgtaggaactaaaaggtcggaacgacgtaccgtaggaaggtaacggtacggaacggaccgtaacggtcttaaagttcgttaaactttacggttgggttcggggcgggggttgggttccgggggttacgggggggcgggtaattcggggaaccggtggggaccggggttccgggggaacccggtaaacccggggg

SEQ ID NO: 374401 - DNA, 603 bp, Homo sapiens
  misc_feature: GZ8MTXP01AW4JN.21.19.B08.1.454.CMB.2.raw
  modified_base (412)..(412): a, c, t, g, unknown or other
  modified_base (417)..(417): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggactcccgccttcagtacctatagtatgtaattggactccgccaggctaccgagggaaggggctggagtggctctcacgtagattaggtggtagtagttagtttcaattatattaacgcaagactcgagtcgcgacggggctactcaccatcncaganaccaacgaccaaagtacttccctagtactctagggaacaaagtggacacgccgaggtaggacgtcgaagggtacctaacgggctaagttgttacttacgttgggtaggtcgggggttagggccggttaggggggaacgggtagtaacggacggacggttcgggaacgggggccccgtaaacggggg

SEQ ID NO: 374402 - DNA, 632 bp, Homo sapiens
  misc_feature: GZ8MTXP01ATNUL.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactcccgccttcagtacctatagtatagaattggactccgcaggctccgaagggaaagggggctgggagtcggctctcacagtattaggtggtagtagttagtttcaattatattaacgctaagactcgagttgacgacggggacctattcccacattccaacgaagacgtaaccaaccgaccaaagtaaccttccctagtactccgtaggaacctaaaagtgggaacctacgcctaggacgtaacggtcggaacggacgtacgtacttaagttgttaaacttcggttgggtcgggtcgggggttcggttggggttcggggggaacggggtatcgggacgtaggggcgggtccggggccgtaaaccggggg

SEQ ID NO: 374403 - DNA, 574 bp, Homo sapiens
  misc_feature: GZ8MTXP01A9GXT.21.19.B08.1.454.CMB.2.raw
  modified_base (367)..(367): a, c, t, g, unknown or other
  modified_base (492)..(492): a, c, t, g, unknown or other
  modified_base (507)..(507): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaaggccgtgggggtccctgagactctcctgtgcagcctctggactcccgccttcagtacctatagtatgaattggatccgcaggctccgaggaaggggctggagtggctctcacagtattaggtgtagtagtagtttcatatataacgnaagactcagtgcgacggggcctattccaactatcctaccaagacgaaccaacgaccaaagtacttccctagtactctagggaactaaagtcggacacgcctaggacgagtacgaggaccacggtntaagtgttattacgnggtcggtcggggttggcggttggggggcgggtagtcggaacgcggcgggtcggggccgtaaccgggg

SEQ ID NO: 374404 - DNA, 640 bp, Homo sapiens
  misc_feature: GZ8MTXP01C1O8V.21.19.B08.1.454.CMB.2.raw
  modified_base (369)..(369): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagccgtggtcaaggccgtggggggtccctgagactctcctgtgcagcctctggactccgcttcagtaccatagtatgtaattggactccgcaggctaccgaagggaaaggggctgggagtcggctcgtcacgagtagttaggtggtagtagttagtttanattatattaacgcaagactcgaggtcgacgacgggacctataccacatcctacgaagacgaacaaccgacaaacgtacttccctagtactcgtaggaacctaaagtcggaactacgaccgtagaggttaacggccgaaggaaccgaccggtattaattaggttaactttaccggttggtacgggtccgggggttaggcggggttacggggggtaacggggagttccgggaacggtcgggaccggggtcgggggaaccccgtaacccggggg

SEQ ID NO: 374405 - DNA, 533 bp, Homo sapiens
  misc_feature: GZ8MTXP01BWEQV.21.19.B08.1.454.CMB.2.raw
  modified_base (323)..(323): a, c, t, g, unknown or other
  modified_base (333)..(333): a, c, t, g, unknown or other
  modified_base (388)..(388): a, c, t, g, unknown or other
  modified_base (454)..(454): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactatttagaaggtgtcagtgtgaggtgcatctggtggagtcgtgggggagctggtcaagccgtgggggtcctgagactctcctgtgcagcctctggatcccgccttcagtacctatagtatgaattgatccgcaggctccgaggaaagggctggagtggctctnacagattagngtagtagtagtttcatatattaagcaagactcagtgacaggggcattcaccatcnccagacgaacacgaccaaagacttacccgtgtatctgggaactaaatcgggacagcctagagtagngagacacggctaatgttatacttggtaggcggggttgcggttgggggcgggtatcgagagcggtcggggctaaccgggg

SEQ ID NO: 374406 - DNA, 540 bp, Homo sapiens
  misc_feature: GZ8MTXP01D56K9.21.19.B08.1.454.CMB.2.raw
  modified_base (340)..(340): a, c, t, g, unknown or other
  modified_base (480)..(480): a, c, t, g, unknown or other
  modified_base (493)..(493): a, c, t, g, unknown or other
  modified_base (507)..(507): a, c, t, g, unknown or other
  modified_base (510)..(510): a, c, t, g, unknown or other
  modified_base (515)..(515): a, c, t, g, unknown or other
  modified_base (521)..(521): a, c, t, g, unknown or other
  modified_base (523)..(523): a, c, t, g, unknown or other
  modified_base (525)..(525): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactatttagaaggtgtccagtgtgaggtgcatctggtggagtcgtgggggaggcctggtcaagccgtggggggtccctgagactctcctgtgcagcctctggatccgccttcagtacctatagtatgaatggatccgcaggctccgaggaaaggggctggagtggctctacacagtattagngtagtagtagtttcatatattaaacgcaagactcagtgacgaggggccgtattcaccatctaccaagacgaaacaacgaccaaagaaacttccctagtatctagggacaaagtggaacagccctgagagcgagacacggntaatgttacttanggtgcgggttgggnggnggggngggagngngngcggtcggcgaacgg

SEQ ID NO: 374407 - DNA, 704 bp, Homo sapiens
  misc_feature: GZ8MTXP01BURN6.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactgggctcgctggttttcctagttactatttagaaggtgtcagtgtgaggtgcatcgtggtggagtcgtgggggagcctggtcaagccgtggggactccctgagactctctgtgcacgcctcgtggactcccgtcttcacgtactatagtatagagttgactccgcaggtctaccggaagggaacgggcgtaggagtggcctcgtacgactaagtagttaggtaggttaagttagtttagttactaagttattaaacgttaacgcaagtactacgaggtcgacggacggggtccctaatttaccaacccgtattacccaacccgaaaggaaaccaacctaaacccgaccgtaaaagtaacctttcccgtaagttactacggtacgtaaagaaactcggaacgtaacgccgttaaagggaaccggtaacggtccgggaaacgggtacaacccggggtaatttaaattcgggtttaaacgttcggtgggggtcggttaccggggggttcggaccggggttaaggggggccgggtaacttgggaaccgttaggggccggttaacggggaaccccgg

SEQ ID NO: 374408 - DNA, 529 bp, Homo sapiens
  misc_feature: GZ8MTXP01DPDKZ.21.19.B08.1.454.CMB.2.raw
  modified_base (364)..(364): a, c, t, g, unknown or other
  modified_base (504)..(504): a, c, t, g, unknown or other
tcagtcgtcgctcgcacgaccggtgctcgatttagtgagtcagtaagggctgagagaggagccttagccctggattccaaggcctatccacttggtgatcagcactgagcaccgaggattcaccatggaactgggctccgctgggttttcctagttactatttagaaggtgtccagtgtgaggtgcatctggtggagtcgtgggggagcctggtcaagccgtgggggtccctgagactctcctgtgcagcctctggatccgccttcagtaccatagtatgaattggatccgcaggctccgaggaaaggggctggagtggctcgtcacagtattaggtggtagtagtagtttcatatattaacgnaagactcagtgcaggggcctattccacatcgtccagagaaccaacgccaaagacttccctgtaatctggacaaagtggaacagcctgagagtcgagacacgctaatgttatacgttgtgcgggttgcgttgggggcgggntgacaggcgtggggccgtaacgggg

SEQ ID NO: 374409 - DNA, 561 bp, Homo sapiens
  misc_feature: GZ8MTXP01DCLKM.21.19.B08.1.454.CMB.2.raw
  modified_base (331)..(331): a, c, t, g, unknown or other
  modified_base (414)..(414): a, c, t, g, unknown or other
  modified_base (417)..(417): a, c, t, g, unknown or other
  modified_base (444)..(444): a, c, t, g, unknown or other
  modified_base (485)..(485): a, c, t, g, unknown or other
  modified_base (501)..(501): a, c, t, g, unknown or other
  modified_base (540)..(540): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggaggcctggtcaagccgtgggggtccctgagactctcctgtgcagcctctggactccgccttcagtacctatagtatgaattggatcccgcaggctccgaaggaaggggctgggagtggctctnacgagtattaggtggtagtacgttagtttcaagttattagttaaacgctaagactacgagttcgacgaggggcctattcaacntcnccagaacgacacgacaaagacttcccngtactcagacaagtcggacagcctgagtagcgagcgacggntaagtgttatttacgnggtcggcgggttggcggttgggggtcggagtcgacgggnggcgggtcgggccggtaacgg

SEQ ID NO: 374410 - DNA, 629 bp, Homo sapiens
  misc_feature: GZ8MTXP01BARVX.21.19.B08.1.454.CMB.2.raw
  modified_base (563)..(563): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctggttttcctagttactatttagaaggtgtccagtgtgaggtgcatcgtggtggagtcgtgggggagcctggtcaagccgtgggggtccctgagactctcctgtgcacgcctcgtggactcccgccttcacgtacctatagtatagtaagttggactccgccgaggcctaccggaaggggaacggggtcgtagggaggtcggcctcgtacaacgagttagttaggtaggttagttagttagttactattaattacttaacgctaacgtactacgtacgtcggacgtacgggacctacttaccaacctactcctacgaagaacgaaaccaaccgtaacctaaagttaccttccctagtactcgtaggaactaaagtcgacagcgtaggagacggtcgaggaccaggtctaagtgttattcgnggtcggtcggggttgcgggttagggggaacgtgtaacgcggcggcgggtaaccggcggtaacccgg

SEQ ID NO: 374411 - DNA, 540 bp, Homo sapiens
  misc_feature: GZ8MTXP01CI6OW.21.19.B08.1.454.CMB.2.raw
  modified_base (473)..(473): a, c, t, g, unknown or other
  modified_base (481)..(481): a, c, t, g, unknown or other
  modified_base (518)..(518): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctcgctgggttttcctagttactattttagaaggtgtccagtgtgaggtgcatcgtggtggagtcgtgggggagcctggtcaagccgtgggggtccctgagactctcctgtgcagcctctggatcccgcttcagtacctatagtatgaattggactccgcaggctccgaggaaggggctggatggctctcacagtattagtggtagtacgtagtttcatatattaacgctaagactcgagtgcgaggggtccattccaccatctaccagagacaacgcaaagacttccctgatctggacaaagtggacagcctgagagtcgaggaccaggctaagtnttattacngtcggcgggttggcggttgggggcggggatcggacgnggcgggtcgggccgaaccgggg

SEQ ID NO: 374412 - DNA, 624 bp, Homo sapiens
  misc_feature: GZ8MTXP01CTYWI.21.19.B08.1.454.CMB.2.raw
  modified_base (537)..(537): a, c, t, g, unknown or other
  modified_base (554)..(554): a, c, t, g, unknown or other
  modified_base (594)..(594): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatctggtggagtcgtgggggaggcctggtcaagccgtgggggtccctgagactctcctgtgcagcctctggactcccgtccttcattaccatagtatgaattggactccgccaggcctaccgaaggaaaggggctaggagtggctctacacagtattagtggtagttaagttagtttacattaatattaacgacaagactcgaagtcgacgacgggccgtattaccacctatcctaccgaagaacgaaaccaaaccgaccaaacgtaaccttaccctagtaactactacgggaactaaaggtcggaacgagtcccgtagacgtaacggtacgaagggtacacgggtntaagtgttaagttacgnggtgggtcgggttggcggttaggggggcggagtcgacggnggttacggtcgggggaacccgtaaccgggg

SEQ ID NO: 374413 - DNA, 695 bp, Homo sapiens
  misc_feature: GZ8MTXP01BJHG3.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatctggtggagtcgtgggggagcctggtcaagccgtgggggtccctgagacctctcctgtgcagcctctggactcccgccttcagtacctatagtatgaattggactccgcaggctccgagggaagggctggagtggctctcacagtattaggtggtagtacgttagtttcattatagttaacgctaagactcgagtcgacgacggggcctacttccgaacctactcctaccgaaggacgaaaccaaaccggaccctaaaggtaacccttccccgtaggttacttaccgtacggggaacctaaaagtcgggaaccaacggtcccgttaagggaacgtaacgggtccggaaacgggaacccgtaccggggtaccttaaggttgttaacgttaccggttgggttacggggcggggggttcgggcggggttcgggggggaaccggggtaagtcgggaacggtaccggggttaccgggttccggggggaaccccggtaaacccgggggg

SEQ ID NO: 374414 - DNA, 578 bp, Homo sapiens
  misc_feature: GZ8MTXP01BPYVG.21.19.B08.1.454.CMB.2.raw
  modified_base (359)..(359): a, c, t, g, unknown or other
  modified_base (371)..(372): a, c, t, g, unknown or other
  modified_base (410)..(410): a, c, t, g, unknown or other
  modified_base (484)..(484): a, c, t, g, unknown or other
  modified_base (540)..(540): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggactcccgccttcaagtactaatagtatgaattggactccgcaggctacgaaggaaaggggctggagtggctctcacagtattaggtagtagtagtagttnagtatataacgnngactcagtcgacgagggccctattccactatcacaganaacacgaccaaagacttcctgtaactcgtaggactaaagtcggacacgctagacgagtcgaaggactacgggtntaagtgttaacgttgttgggtcggagggttgggttcggttacgggggaaggggtanaacgggcgtacgggcggtaacggggaaccgtaaccggg

SEQ ID NO: 374415 - DNA, 602 bp, Homo sapiens
  misc_feature: GZ8MTXP01CGKAG.21.19.B08.1.454.CMB.2.raw
  modified_base (572)..(572): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggactccgcaggctccgaggaaaggggctggagtggctctcacgagtattagtggtagtacgttagttcatatattaacgcaagactcgagtgcgacggggccgattccaactatctaccagacgaacaacgccaaagtacttccctagtactcgtaggacaaagtcggaacagtccctaggacgacgtacggaaggacgaccgggtctaagttacggttattaaccgttgggtcgggtggggttcgggcgggttggggggaaccggggtatgggaaccgnggccggtcgggggaacccgtaacccggggg

SEQ ID NO: 374416 - DNA, 644 bp, Homo sapiens
  misc_feature: GZ8MTXP01DTBAH.21.19.B08.1.454.CMB.2.raw
  modified_base (142)..(142): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgntgggttttcctagttactatttagaaggtgtccagtgtgaggtgcatctggtggagtcgtgggggagcctggtcaaggccgtgggggtccctgacgactctcgtgtgcagcctgtgactccgcttcagtactatagtatagtaattggatcccgcacggctaccgaagggaaagggggctagggagtggctctcacgagtaagttaggtggtagttacgttagtttacattattacttaacgactaagactcgtaaggtcgaccgaacggggtcctaaattcccaactacttacccaaccgaagaaccgaaccgaaaccgtaccaaacggttaccttcccctaagttaacttcctagggaaactaaagtcgggaactaagccgtagacggtaaacgtcggaaggtacacggtctaaagttgttaatggttggcgggtcggggttgggttcgggttagggggcggggtaggtgacggacggcgggtcgggcggtaacccgggg

SEQ ID NO: 374417 - DNA, 612 bp, Homo sapiens
  misc_feature: GZ8MTXP01B931V.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggactcccgccttcagtacctatagtatgaattggatccgccagcctccgaggaaaggggctggagtggctctcacgagtattagtggtagtacgttatttcgatatattaacgcaagactcgagtgacgacgggaccgactttccactatcctaccgaagacgaaaccaaccgactaaacgtaccttcccgtagtactcgtacggacaaagtcggactaacgcctaggaagtacgtcggaacggacacgggtcttaagtcgttattaccgttggtaccgggtggggttcgggcgggttggggggaaccgggtatcggaacggtggttccgggtcgggggcccgtaacccggggg

SEQ ID NO: 374418 - DNA, 592 bp, Homo sapiens
  misc_feature: GZ8MTXP01DE1V9.21.19.B08.1.454.CMB.2.raw
  modified_base (367)..(367): a, c, t, g, unknown or other
  modified_base (374)..(374): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtatccagtgtgaggtgcatctggtggagtcgtgggggaggcctggtcaaggccgtggggggtccctgagactctcctgtgcagcctctggactccgccttcagtacctatagtatgaattggatccgcaggctaccgaggaaggggctggagtggctctcacagtattagtgtagtagtagttcatatattacgnaagactnagtgcgagggcgattcacatctcagacgaacaacgaccaaagtaacttccctagtactacgttaggactaaacgtggaaccacggccctagaggacggtccggaaggaccgacgggtcttaagtcgttaagttacgttggtcgggtcggggttcgggttcgggttggggggcggggaagtcgggaacgagggccgggtcgggggcccggtaaccgggg

SEQ ID NO: 374419 - DNA, 529 bp, Homo sapiens
  misc_feature: GZ8MTXP01DY46B.21.19.B08.1.454.CMB.2.raw
  modified_base (421)..(421): a, c, t, g, unknown or other
  modified_base (438)..(438): a, c, t, g, unknown or other
  modified_base (441)..(441): a, c, t, g, unknown or other
  modified_base (468)..(468): a, c, t, g, unknown or other
  modified_base (486)..(486): a, c, t, g, unknown or other
  modified_base (490)..(490): a, c, t, g, unknown or other
  modified_base (496)..(496): a, c, t, g, unknown or other
  modified_base (501)..(501): a, c, t, g, unknown or other
  modified_base (505)..(505): a, c, t, g, unknown or other
  modified_base (507)..(507): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggatcccgcttcagtacctatagtatgaaattggatccgcaggctaccgaggaaaggggctaggagtggctctcacagattagtggtagtagtagtttacatatattaacgcaagactcagtgcgaggggccaattcacctagtcacaagagaacaacacaanaactcctatatctaganaanagacacgcgagagagacgagacgacgntaatgttatagttgtggngggnggcggnggggngggngngacgagcggtcgggcggaacgg

SEQ ID NO: 374420 - DNA, 640 bp, Homo sapiens
  misc_feature: GZ8MTXP01BPRJT.21.19.B08.1.454.CMB.2.raw
  modified_base (372)..(372): a, c, t, g, unknown or other
  modified_base (540)..(540): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggactcccgccttcagtacctatagtatgaattggactccgcaggctaccgaaggaagggctaggagtcggctctcacgagtagttagtggtagtagttagtttcatatataacncaagactacgagtcgacgacgggcctattccacgatcctacgaagacgaaacgaaccgacaaacgtaaccttcccgtagttaactcgtaggaactaaagtcgggaactacgccgtaggaagtacggtacgaagggtaaccacgggtctaagttaagttactttacggnggtacgggtccggggttggggcccggggttaggggggaacggggtattaacggaaccgggcggttccggggttaacgggggaacccgttaaaacccgggg

SEQ ID NO: 374421 - DNA, 565 bp, Homo sapiens
  misc_feature: GZ8MTXP01DIMY4.21.19.B08.1.454.CMB.2.raw
  modified_base (357)..(357): a, c, t, g, unknown or other
  modified_base (368)..(368): a, c, t, g, unknown or other
  modified_base (480)..(480): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtggggggagcctggtcaagccgtggggggtccctgagactctcctgtgcagcctctggatcccgccttcagtacctatagtatgaattggatccgcaggctaccgaggaaaggggctggagtggctctcacagattagtggtagtagtagtttnatatattaacncaagactcagtgcgagggcgattcaccatcacagagacaacgaccaaagacttccctagtatactagactaaagtcggaacacgcctaggagaagtcgaagggaccaccggnttaagtagttattacgttggtgggcggggttggcggttgggggcggggaatcggacgaggccgggtaaggggcccgtaaccgggg

SEQ ID NO: 374422 - DNA, 580 bp, Homo sapiens
  misc_feature: GZ8MTXP01AJGR3.21.19.B08.1.454.CMB.2.raw
  modified_base (336)..(336): a, c, t, g, unknown or other
  modified_base (505)..(505): a, c, t, g, unknown or other
  modified_base (538)..(538): a, c, t, g, unknown or other
  modified_base (562)..(562): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaaggccgtggggggtccctgagactctctgtgcagcctctggactccgccttcagtaccatagtatagaattggactccgccaggcctccgagggaaacggggctgggagtggctcncacagattagtggtagtagtagtttcagttatattaacgcaagactcgagtcgcgaggggcctattccacctatcctaccacgaacgaaccgaaacgaccaaacgtacttccccgtagtactcctaggggaacaaagttcggaaccagccgtgacgagtcgaggtaacncgggtctaagtgttatacgttggtaggtcgggnggcgttgggggcgggatcggacgnggcggtcgggcgtaacgg

SEQ ID NO: 374423 - DNA, 646 bp, Homo sapiens
  misc_feature: GZ8MTXP01BX4WJ.21.19.B08.1.454.CMB.2.raw
  modified_base (401)..(401): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagcctgggggtccctgagactctcctgtgcagcctctggatccgccttcagtacctatagtatgaattggactccgcaggctccgaggaaggggctggagtggctctcacagtattagtggtagtagtagtttcatatattaacgcaagactcagtgcgaggggcattcactatctccaganaaccaacgaccaaagtaacttccctagtactccgttagggacctaaaagtcgggaacacggtcccgaggaagacgggttcgaacgggaacctacgggtaccttaagtcgtttaaacgtttaaccggttgggtcggggtccggggggttgggttcccggggtttgggggggggaaccgggggttagttcgggaaacccggggtacgggttaccgggggtaaccgggggaacccgggtaaccggggg

SEQ ID NO: 374424 - DNA, 636 bp, Homo sapiens
  misc_feature: GZ8MTXP01DA81E.21.19.B08.1.454.CMB.2.raw
  modified_base (328)..(328): a, c, t, g, unknown or other
  modified_base (367)..(367): a, c, t, g, unknown or other
  modified_base (409)..(409): a, c, t, g, unknown or other
  modified_base (438)..(438): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtggggaggcctggtcaagccgtgggggtccctgacgactctcctgtgcacgcctctggactcccgcttcagtacctatagtatgaattgatccgcaggctccgaggaaagggctggagtggctcncacagattgtgtagtacgtagttcatatattaacgcaanactcgagttgcgacggggccattccacctatcgtacaggaanacgaaacgtaccaaagacttcccagtacnctacggggactaaaggtacgacgtaacgccgtgaacggtaagccgaacggactaaccgggtattaagttcggttaatttaacccggttggtacggggtcgggggtttcgggcccggggttaggggggaaccggggggttaaagtaacggggaaccggacggggttaccggggtaaccgggggaacccggtaaccgggg

SEQ ID NO: 374425 - DNA, 677 bp, Homo sapiens
  misc_feature: GZ8MTXP01CI3AV.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggactcccgccttcacgtacctatagtatgtaattggactccgcaggcctaccgaagggaaacgggggcgtagggaggtggcctactcactagtattaggtaggttagtaagttagtttacaagttattacttaacgactaaggtactacgaggtcgacgacggggccgtattaccaacctatcctaccgaagaacgaaaccaaaccggacctaaacgtaaccttccccgtagtactcgtaggaactaaagtcggaacacgcccgtaggaacgaacggtacggaaggtaccgacgggccttaagtacggttactttaccgttgggtacggggtcgggggttcgggcggggttacggggggaacgggggtattcgggaaccggtaggggccgggtaacgggggaacccggtaacccggggg

SEQ ID NO: 374426 - DNA, 709 bp, Homo sapiens
  misc_feature: GZ8MTXP01DSG8R.21.19.B08.1.454.CMB.2.raw
  modified_base (381)..(381): a, c, t, g, unknown or other
  modified_base (418)..(418): a, c, t, g, unknown or other
  modified_base (506)..(506): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtcagtgtgaggtgcatctgggtggaggtcggtggggggaggccgtgggtcgaacggccgtcggggggtccctggacgactctcctgtgcagcctcgtgactccgcttcacgtactatagtatgaagttgactccccgcgaggcctaccggaaggggaaacgggggcgtagggaggtcgggtctccgtacaacgagttagtttaaggngggttaagttagttagtttcaattaatattaaaccgnaagactacgaggtcgcggaacggggtcctattcccaacctatccctacgaagaacgaacaaccgacaaacgtaccttcccagttaacncgttagggaacctaaagtagggacaacggccgttaggaaggtacggccgggaaaggtaccgacggtacgttaatacgggtttaactttccgggttaggtccgggggttcgggggttaacgggggttccgggttagggggggggccgggtaaggtcgggacgaacggggcgggtaaccgggggttccccggtaaacccgggggg

SEQ ID NO: 374427 - DNA, 596 bp, Homo sapiens
  misc_feature: GZ8MTXP01CKCA6.21.19.B08.1.454.CMB.2.raw
  modified_base (381)..(381): a, c, t, g, unknown or other
  modified_base (478)..(478): a, c, t, g, unknown or other
  modified_base (514)..(514): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactcccgccttcagtacctatagtatgaattggactccgcaggctccgaaggaagggggctgggagtggctctacacgagtattaggtggttagtagttagtttacattatattaacgcngactcaggtgcgacggggcctattccaactactcctacgaagacgaacaaccgacaaacgtaacttccctagtactcgtaggactaaagtcggaacngtaccgtagaaggtaggtacggaaggacgaccggtntaagtgttattacgttggtcggcggggttggcggttggggggcggagtggacggtacggcggtcgggggccgtaaccggggg

SEQ ID NO: 374428 - DNA, 690 bp, Homo sapiens
  misc_feature: GZ8MTXP01DFVMZ.21.19.B08.1.454.CMB.2.raw
  modified_base (414)..(414): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatcgtggtggagtcgtgggggagcctggtcaggccgtgggggtccctgacgactctcctgtgcacgtcctcgtggactcccgtccttcaacgttacctatagtatgtaaagttggactcccgacgacggcctaccggaagggaaagggggtcgtagggagtcggtctccgtacacgtagttagttagtgggtaagttagttagtttcattaattacttaacganaagactcgagtcgacgagggcctattcccactactcgacagaacgaaacctacgactaaacgtaacttccccgtatacttccaaggaacctaaagtcgggaactacggtacccaggaacgtacggtaccggaagttaccgaccgggttattaaagttcggttaaattttcggccgggttggggtcgggggttaccgggttgggggacggggggtaaccgggtataacccggggagacgggggttccggttccgggggaaacccggtaacccggggg

SEQ ID NO: 374429 - DNA, 616 bp, Homo sapiens
  misc_feature: GZ8MTXP01DLWJD.21.19.B08.1.454.CMB.2.raw
  modified_base (366)..(366): a, c, t, g, unknown or other
  modified_base (398)..(398): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggagcctggtcaaggccgtggggggtccctgagactctcctgtgcagcctctggatcccgcttcagtaccatagtatgaattggactccgcaggctccgaggaaaggggctggagtggctctcacagtattagtggtagtagttagttcatatattaacncaagactcgagtcgcgagggccgattcaaccntctcaagacgacaacggaccaaagtacttcccgtagtactcagggactaaaagtcggaacagtacccgtaggaaggtaacggtcgaaccgggaacgaccgggtcttaaagttcgttaagttacgttgggtacgggtcgggggttcggccgggttggggggaaccggggtagttcggaacgggacggttacgggtcgggggcccgtaaaacccgggggg

SEQ ID NO: 374430 - DNA, 658 bp, Homo sapiens
  misc_feature: GZ8MTXP01A28GR.21.19.B08.1.454.CMB.2.raw
  modified_base (249)..(249): a, c, t, g, unknown or other
  modified_base (252)..(252): a, c, t, g, unknown or other
  modified_base (562)..(562): a, c, t, g, unknown or other
tcagtcgtcgctcgcacgaccggtgctcgatttagtgagtcagtaaggggctgagagaggagccttagccctgaattccaaggcctatccacttggtgatcagcactgagcaccgaggattcaccatggaactggggctccgcttgggttttcctagttacttattttagaaggtgtccagtgtgaggtgcatctggtggagtcgtgggggagcctggtcaagccgtgggggtccctgagctctctgtncancctctgactcccgtcttcagtactatagtatgtaagtgactccgccgacggtctaccgaagggaaacggggtgtcggtagtcggctcacacgtagtaagttaggtaggttagttacgttagtttacatatataacgacaacgactcgtagtcgacgacgggtcgtattcccacactcctaccgagaacgtaaccaaccgacctaaagtacccttccgtagtaacttcaggaactaaaggtcgaaaccgtagccgtaggagtaacgtcggaaacgtaccgtaccggtatttaacgttagttacgttacggnggtagggtcccggggttgggccgggttggggggaacgggtagtaacgggtacgggaccgggttccgggggtaaccggggaacccggtaacccgggg

SEQ ID NO: 374431 - DNA, 620 bp, Homo sapiens
  misc_feature: GZ8MTXP01BMB9G.21.19.B08.1.454.CMB.2.raw
  modified_base (544)..(544): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactcccgccttcagtacctatagtatgaattggactccgcaggctaccgaggaagggctggagtcggctctcacgagtagttagtggtagtagttagtttacattatattaacgctaagactcgagtcgacgacggggcctagttccactatcctaccgaagacgaaccaaacgaccaaagtacttcccgtagtactccgtaggaacctaaagtcggaacaggtccctaggacgtacggtacgaacgggacctacgggtcttaaggttaccgttatttacggngggtcggcggggttggccgggttggggggaacgggtatgggaccggtggacgggttcggggaacccgtaaccgggg

SEQ ID NO: 374432 - DNA, 673 bp, Homo sapiens
  misc_feature: GZ8MTXP01DY400.21.19.B08.1.454.CMB.2.raw
  modified_base (302)..(302): a, c, t, g, unknown or other
tcagtcgtcgctcgcacgaccggtgctcgatttagtgagtcagtaaggggctgggagaggagccttagccctggattccaaggcctatccacttggtgatcagcactgagcaccgaggattcaccatggaactggggctccgctgggttttcctagttactattttagaaggtgtccagtgtgagtgcatctggtggagtcgtgggggaggcctggtcaaggccgtgggggtccctgagactctcctgtgcagcctcgtggactccgccttcagtacctatagtatgaattggatccgccgngtcacggaagggacggcgtggacgcggtctcacacgagttagttgtaggtagtagttacgttactattatacgttacgaacgaacgtcacgtagcggacggacggggtacctacgttacccactacttccgaacgaacggtaacaaaccgaaaccggtacctaaacgttacccttaccgtagtactacgtacgtaaacgtaagtacggaaccacgtacgtagaggacgtacggacgtacgaccggtattagtaacgttacgttacgtgggaccggtggggtcgggttcggggttcggggggacggtaaggtaccggtaacgtacggggtacgggttaccggggaaccgggttaaccccgggttaaccccgg

SEQ ID NO: 374433 - DNA, 583 bp, Homo sapiens
  misc_feature: GZ8MTXP01EDUBS.21.19.B08.1.454.CMB.2.raw
  modified_base (520)..(520): a, c, t, g, unknown or other
  modified_base (558)..(558): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggactccgccttcagtacctatagtatgaattggatccgcaggctcgaggaaggggctggagtggctctcacagtattaggtggtagttacgttagtttacaagttattattaaacgcaagtactcgagtgacgaggggcctattccactatcacagacgaacaacgaccaaagacttccctagtatctagggactaaagtggacagccgtaggaacgtaggtcggaagggtaccacgggtctaagtggttaatacgttggngggcggggttgggcggttggggggcgggtatcggacgngggccggtcgggggccgaaccgggg

SEQ ID NO: 374434 - DNA, 639 bp, Homo sapiens
  misc_feature: GZ8MTXP01CY202.21.19.B08.1.454.CMB.2.raw
  modified_base (279)..(279): a, c, t, g, unknown or other
  modified_base (378)..(378): a, c, t, g, unknown or other
  modified_base (390)..(390): a, c, t, g, unknown or other
  modified_base (396)..(396): a, c, t, g, unknown or other
  modified_base (417)..(417): a, c, t, g, unknown or other
  modified_base (519)..(519): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatcgtggtggagtcgtgggggagcctggtcaaggccgtgggggtccctgacgactctcctgtcgcacgtcctcgtggactcccgtccttnaacgttacctatagtatagaagtttggactccgcaggcctaccgagggaaagggctggaggtcggctctacacgagtattaggtgtagttactagttanatatataacgangtactnagtgcgacgggtcatccacgntacctcaagacgaacaacgacaaagtacctccgtagtacttcaggaactaaaggtcgacgtagtcccgtaggacgtaacggtcggaacggtacgaccgggtnttaagttgttaacgtttaccgttgggtaggggtacccggggttcgggggttggttacggggggaacgggttagcgggtaacgacggggttaccgggtccgggggaaccgtaaccccgggg

SEQ ID NO: 374435 - DNA, 706 bp, Homo sapiens
  misc_feature: GZ8MTXP01CO9WO.21.19.B08.1.454.CMB.2.raw
tcagtcgtcgctcgcacgaccggtgctcgattttagtgagtcagtaaagggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaaggccgtgggggtccctgagactctcctgtgcacgcctcgtggactccctaccttcacgtacctatagtatagtaatggactccgaccgaggcctaccggaaggggaaaggggcgtaggagtcgtactcgtacacgtaggtatttaggtggttaagttacgttagtttacattaatagttaacgcaagtactcgaggtgacgacggggtacctacttacccaacctattaccctacgaaagtaaccgaacctaaaccgaccgtaaaacgtacctttcccgtagtacgtaccaggtaacgtaaagtcggaacgacgtccgaaggacggtaacggtcggaaacggacgtaccggtcttaaggtacgttagtttacggttgggttcggggtacgggggttcggggttcggggttcggggggggtaacgggtgttaacgggacggacggggttacgggggaacccgggggaacccgggtaaccccggggg

SEQ ID NO: 374436 - DNA, 622 bp, Homo sapiens
  misc_feature: GZ8MTXP01BS0QM.21.19.B08.1.454.CMB.2.raw
  modified_base (380)..(380): a, c, t, g, unknown or other
  modified_base (387)..(387): a, c, t, g, unknown or other
  modified_base (391)..(391): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatcgtggtggagtcgtgggggaggcctggtcgaagccgtggggggtccctggagactctcctgtgcagtcctcgtgactcccggtccttcacgttaccatagtatagaattggactccgcaggctacgaggaacgggcgtggagtgctctcacagtattagtgtagtagttattacattatagttaacacngtactcnggtnacggacgggacctagttacccacgtctacctaccgaagacgaaaccaaccgacctaaacgtacttccctagttactccgtaggaactaaagtcggaacaagccgtagaagacgtacgaggtaccacgggtcttaagttagttacttacggttggtaggggtccggggttgggcgttcggggggaacgggtagcgggtaagcggttgggtccgggggaaccgtaaccggggg

SEQ ID NO: 374437 - DNA, 713 bp, Homo sapiens
  misc_feature: GZ8MTXP01BMGFZ.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactatttagaaggtgtccagtgtgaggtgcatctggtggagtcgtggggagcctggtcaagccgtgggggtccctgagactctctgtgcagcctctggactcccgtccttcagtacctatagtatgtaattggactccgcgaggcctacgaaggaaggggctaggagtcggctctacactagtagttagtggttagttagttagtttacaagtattacgttaacgcaagtactgaggtcgacgagggaccgtacttccgaacctactacgtaccgaaacgaacgaaacccgtaaaccgtaacccgtaaacggttaaccctttacccccgtaggttaacctttaccgtaacggggtaaacttaaaacggttcgggaaaccgtacggtacccgttaagggaacggtaacggtaacgggaacgggtaacccgtaacgggtccttaaagttccgtttaaagtttaccgttggggtcgggtcggggttacgggttcggggttacgggggaagggtacgtcggaacggcggttacgggttccgggaaccgtaacccggggg

SEQ ID NO: 374438 - DNA, 642 bp, Homo sapiens
  misc_feature: GZ8MTXP01ETGFX.21.19.B08.1.454.CMB.2.raw
  modified_base (173)..(173): a, c, t, g, unknown or other
  modified_base (294)..(294): a, c, t, g, unknown or other
  modified_base (551)..(551): a, c, t, g, unknown or other
  modified_base (594)..(594): a, c, t, g, unknown or other
  modified_base (604)..(604): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtntcagtgtgaggtgcatcgtgggtggaggtcggtggggggaggccgtgggtaccaacggtccggtcgggggggttccctggacgtaccttctcctgtgcacgcctcgtggctcccgtccttnagtactatagtatgaattggctccgcgagcctacggagggaaggggctaggagtggctcctacaacgagttagttaggtggttaagttacgttaagtttacaattattaacgtaacacgtaagtactcgtaggtcgacggtaacggggccttactccgactactccaccaaggacaaccaaccgtacaaacgtaccttcccgtagtactccgtagggaacctaagtcgacagtcgagagacgtacgacggcacggtntaatacgttagtacgttgggagggtcggggttggttcgggggnggggtaaggngtaacggacggcgggcgggtaaccggggccgtaaccgg

SEQ ID NO: 374439 - DNA, 744 bp, Homo sapiens
  misc_feature: GZ8MTXP01CJDMZ.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctggttttcctagttactatttagaaggtgtccagtgtgaggtgcatcgtggtggagtcgtgggggagctggtcaagccgtgggggtccctgagactctcctgtgcagcctcgtgactcccgtccttcactacctatagtatgtaagtggactccgacaggccgtaccggaggaaaggggctagggtagtcggtctcgtacaacgtagttaagttaggtggttaaggttagttacgtttataattattaacgttaacgacaacgtacttacgagtcgacggacggggtaccctagttacctaccgacgttacctacgaaacgaacgaaacccgaaccgtaacctaaacggtaacctttccgtacgttacgttaccgtaacggtaacgtaaacgtcggaaacgtccgtaaccgttagggaacgtacgggtaacggaacgggtaaccgtaacgggttaccttaacggtttaagtttaaccgtttaaacgggttgggttacgggggtcgggggttcggggttacccgggggttagggggaacggggtacggtaacggaacccggttggggttaccgggtccgggggaacccggtaaaccccggggg

SEQ ID NO: 374440 - DNA, 613 bp, Homo sapiens
  misc_feature: GZ8MTXP01C4Y42.21.19.B08.1.454.CMB.2.raw
  modified_base (236)..(236): a, c, t, g, unknown or other
  modified_base (389)..(389): a, c, t, g, unknown or other
  modified_base (424)..(424): a, c, t, g, unknown or other
  modified_base (427)..(427): a, c, t, g, unknown or other
  modified_base (528)..(528): a, c, t, g, unknown or other
  modified_base (539)..(539): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtggggggagcctggcaaggccgtgggggtcccngacgactctctgtgcagcctcgtggactcccgtcttcagtacctatagtatgaattggactccgacagctacggaagggaaggggctagggagtggctctacacgtagtagtttaggtggtaagttacgttagtttacattatattaaaccgnaaggtactcgagtcgcgaggggtcctacttcactntcnccgaagacgaaacaccgacaaacgtacttccagtactacctaggaacaaagtcgacgagtccgagaggtacgaggacgacgacgtctaattgttaattcgnggttcgggggnggggttacgggttcgggggttcggggaaggtagtggacgggtcggttacgggtaaccggggaaccggtaaccgg

SEQ ID NO: 374441 - DNA, 661 bp, Homo sapiens
  misc_feature: GZ8MTXP01EXIDQ.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctgggtggagtcgtgggggagcctggtcaagcctggggatccctgagactctcctgtgcagcctcgtggactcccgccttacagtacctatagtatgaattggatccgcaggctacgagggaagggctgggagtcgctcgtcatagtagttaggtggtagttagttagtttcattactaattacgcagtactcgagtcgacggacgggtcctactttccaccgtaatccctaaccaggaaccgaacgtaaacccgacccgtaaacgtaaccttccccgttaagttaccctagttacggaaactaaacgtcgggaaccacggtccgttaggaacgtacggtaacggacggacctacgggtaactttaagttagttaacgtttacggtggtacggggttcgggggttcgggcgggttaaggggggcgggtaagtcgggaacgttcgggccgggggttaaccgggaacccggg

SEQ ID NO: 374442 - DNA, 745 bp, Homo sapiens
  misc_feature: GZ8MTXP01ATZXY.21.19.B08.1.454.CMB.2.raw
  modified_base (375)..(375): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggatcccgccttcagtacctatagtatgaattggactccgccaggctccgaaggaaaggggctggagtggctctcacagtattagtggtagtagttagtttacagttattagttaacncaagtactcaaggtgacgtacggggaccgtaacttcccaacctacgttaccctaccgaaaggaacgaaacccaaaccgggtaccctaaaacggtaaacctttccccctaggttaaccttaccgttacggggaaccttaaaaggtcggaaccccgaaggtaccccgttagggaaccggttaaacggtccgggaaccgggaaacctaccgggtaccgtttaagtggttttaaacgtttaacccggttggggttccggggtccggggggttggttccgggggttcggggggggaacccgggggtatttaacgggggacccgttaagggggcccggggtttaacgggggggaacccccgtaaaaccccgggggg

SEQ ID NO: 374443 - DNA, 714 bp, Homo sapiens
  misc_feature: GZ8MTXP01CB7CP.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagccgtggtcaagccgtgggggtccctgacgactctcctgtgcagcctcgtggactcccgtccttacacgtacctatagtatagtaagttggctcccgccgaggcctaccggagggaacggggtcgtggagtcggctctcacgtagtagttaggtggtagttacgttagtttacattacttacgttaacgactaagtactacgtaggtcgaccggacggggtaccgtactttacccgacctacgttacctacccgaaggaacgaaaccgaaaccgtacctaaacggttaccctttacccgtagttactacccggttagaacgtaaacggtcgaaccgacgtacccgtaggaacggtacggtacgaacggaaccgtacggtcttaagttcgtttacgttacgttggggtacgggtccgggggttgggttcggggttcggggggaacgggtgtaacgggaacggttcggggacccggggttcgggggaaccccgttaaccccggggg

SEQ ID NO: 374444 - DNA, 621 bp, Homo sapiens
  misc_feature: GZ8MTXP01EI0P0.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggactcccgtccttcagtacctatagtatgaattggactccgccaggcctaccgaagggaaggggctagggagtggctctacacgagtattaggtggtagttagttagtttacaattataacgttaacgacaagtactcgagtgcgacgggcctattccactatcctacagacgaacaaccgacaaagtaccttcctagtatccgtaggaactaaagtcggaacagccgtaggaacgtacggtcggaaggtacacgggcttaagttcgttaagttaccgttgggcgggtacgggggttgggttccgggttggggggaaccgggatcgggacgtcgggacggttccgggggccgtaacccgggg

SEQ ID NO: 374445 - DNA, 627 bp, Homo sapiens
  misc_feature: GZ8MTXP01B8Y8N.21.19.B08.1.454.CMB.2.raw
  modified_base (588)..(588): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactatttagaagtgtccagtgtgaggtgcatctggtggagtcgtggggagcctggtcaagcctgggggtcctgagactctcctgtgcagcctctgactccgccttcagtaccctatagtatgaattggactccgccaggcctaccgaggaagggctggagtggtctctcacagtattagtgtaagtaggttagtttacatatagttaaacgcaagactcgaagtcgacgaggggccacttacaccgtattcaccgaagaacgaacctaaacggacctaaagaaccttcccctaggaacttccgagggtaaccaaagttcgggaaccaacgcccgtagaacggtaacgtcggaacgggaaccctagggtactaacgtttagttacgtttaacgttgaaacggtccggggttggccggttagggggaaccggngttaacccgaggtcgttcggtaacgggcgaaacccgggg

SEQ ID NO: 374446 - DNA, 707 bp, Homo sapiens
  misc_feature: GZ8MTXP01CLUIJ.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatcgtggtggagtcgtgggggagcctggtcaagccgtgggggactcccgtgagtattctcctgtcgcacgtcctctggactcccgccttcgacgtacctagtagtatagtaagttggactcccgaccgaggcctaccgaaggggaaacgggggcgtagggagtcggtcctcgtacgactaggtaagtttaggtaggttaacgttaggttagtttctaattattaaacgttacgctaaggtactcgaagtcgacgacgggaccctattaccaccgtatccgtaccgaaggaacgaaccgaaacccggtaacctaaacggttaaccctttaccccgtaggttaccttaccgggtacgtaaacctaaaggttacgggaacctacggtcccgttagggaacgtacggtacggaacggttaaccgacggtaacttacgttagttacgttacgttgggtccggcggggttggcgggttgggggcggtaagtcgggacgttcggggcgttccgggggtaacccg

SEQ ID NO: 374447 - DNA, 629 bp, Homo sapiens
  misc_feature: GZ8MTXP01DN4NQ.21.19.B08.1.454.CMB.2.raw
  modified_base (379)..(379): a, c, t, g, unknown or other
  modified_base (553)..(553): a, c, t, g, unknown or other
  modified_base (604)..(604): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccattgtgaggtgcatctggtggagtcgtgggggagcctggtcaagccgtgggggtccctgagactctcctgtgcagcctctggactcccgcttcagtacctatagtatgaattggactcccgcaggctccgaagggaaggggctagggagtggcctctcacagtattaggtggtagttagtagtttacattatattaaccgcngactacgagtcgacgagggggccctattcccacctatcctaccaaggaacgaaaccaacgaccaaagtaacttccccgtagtaactcgttacggaactaaagttcgggaacacggtccctaggaacggtaaggtaccggtaagggaccacgggtactaattgttaagtttacgnggtgggtccgggggttggttccgggttaggggggcggggtatcgggaacgnggttccgggtcggggccgtaacggg

SEQ ID NO: 374448 - DNA, 599 bp, Homo sapiens
  misc_feature: GZ8MTXP01ANET9.21.19.B08.1.454.CMB.2.raw
  modified_base (379)..(379): a, c, t, g, unknown or other
  modified_base (410)..(410): a, c, t, g, unknown or other
  modified_base (426)..(426): a, c, t, g, unknown or other
tcagtcgtcgctcgcacgaccggtgctcgattttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctgggtcaaggccgtggggggtccctgagactctcctgtgcagcctctggatcccgccttcagtacctatagtatgaattgatccgcaggcctacgaaggaagggctggagtggctctcacgtagtattaggtggtacgtacgttagtttcattatattaacgcngactcgagtgcgagggctattccactatccncgaagacgactaaccncgtaaacgacttcccgtaagtactcgtaggaacaaagtcggaactacgccgtagagtagcggaagaccgaggtctaagttcgttaattacgttgggtacggtcggggttgggttccggaggggggccggtagtaacggcggagggccggtaacgggggaacccgtaacggggg

SEQ ID NO: 374449 - DNA, 660 bp, Homo sapiens
  misc_feature: GZ8MTXP01DNR54.21.19.B08.1.454.CMB.2.raw
  modified_base (252)..(252): a, c, t, g, unknown or other
  modified_base (362)..(362): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactcttcctgtgcngcctctggatcccgtccttcaagtacctatagtatgtaaattggactccgcaggctcgaggaagggctggagtcggctctcactagtattagtggtagttagtagtttanattatactaacgcaagtactcgagtgcgagggtcgtacttacacgtatcctaccaagacgaactaaccggactaacgaacttccccgtattaactcgtacgaaccgtaaagtacggaaccgtagtcccgtagaacggtaaccggttcggtaaacgggaaccctacgggtacctaacgtttggttaactttaacgggttggtaggggtacgggggttcggggttcggggttggggggaaccgggggtaagtcgggaacggtacggacgggtccgggggttaaccggtaaaccccggggg

SEQ ID NO: 374450 - DNA, 664 bp, Homo sapiens
  misc_feature: GZ8MTXP01DEWE8.21.19.B08.1.454.CMB.2.raw
  modified_base (632)..(632): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaaggccgtggggggtccctgagactctctgtgcagcctctcggactccgccttcagtacctatagtatagtaattgactcccgcgacggcgtaccgaagggaaggggcgtggagtggctctcacgtagtagttagtggtagttagttagtttacattaatacgttaacgactaaggtactccgaggtacgacggacgggtaccgacttaccacctacgtacctaccgaaggaaacgaaaccgaaccgtaaccaaacgtaaccttacccctagttactccgtaaggtaacaaagttacggactacggaccgtgacgtacgtacggaggaaccgacggtataacgtttagttacttacggttggtacgggtcggggttcggttggggttcgggggtaacggggaagtcggaacgngggccggtcgggggaacccgtaaacccggggg

SEQ ID NO: 374451 - DNA, 660 bp, Homo sapiens
  misc_feature: GZ8MTXP01CKDWX.21.19.B08.1.454.CMB.2.raw
  modified_base (255)..(255): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcacatggaactggggctccgctgggttttcctagttactattttagaaggtgtccagtgtgaggtgcatctggtggagtcgtgggggaggcctggtcaagccgtgggggtcctgagactctcctgtgcagcctntggactcccgcttcagtaccatagtatgaattggactccgcaggctcgaggaaggggctggagtggctctcacagattagtggtagtataggttcatatattaacgctaagactcaggtcgacaacgggggcaacttcaccaacgttccaccgaagaacggaaccaaacggaacccaaaggtaaactttccccgtagtaactcggtacggaaccgtaaaagtcgggaaacacggccttaggagtaacggtacgaacgggtaactaccgggccttaaaggttcgttaagtttaacgttggggttacggtccggggggtttgggccgggttaggggggaacccgggggaagttcgggaaacccggtcggggttaccgggtaacggggggttaacccggtaaccgggg

SEQ ID NO: 374452 - DNA, 685 bp, Homo sapiens
  misc_feature: GZ8MTXP01BB8RL.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgagtgcatctggtggagtcgtgggggagctggtcagccgtgggggtccctgacgtactctctgtgcacgcctctgactcccgtccttcagtacctatacgtatagtaagttggactcccgcgacggccgtaccggaaggggtaagggcgtaggaggtcggtacctctacgacgtagtagtttaggtaggttacgttagttagtttacattaattacttaaacgctaacggtactcgaagttcgaccgtacgggccttacgttccactactaccgtacgaagacgaacgaaccgtaccgaaacttaccttaccgtacgttaatccgtacggtaacgtaaacggttaggaaccgtagtaccggtagacggtacggtacggaggtaccgacggtacttaagttacgttagttacggttcggtggggtacggggttgggttacgggttggggggaacggtacgtaaggaccggcgggttacgggccggggttaacggaacccgggg

SEQ ID NO: 374453 - DNA, 790 bp, Homo sapiens
  misc_feature: GZ8MTXP01BUKBE.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggagcctggtcaagcgtgggggtccctgagactctcctgtgcagcctctggactcccgccttcacgtacctatagtatgaattggatccgcaggcctacgaaggaaaggggctggagtggctcgtcacgagtaagtttaggtaggttagtaacgtttagtttacgaattaattacgtttaaacgccgtaagtacctacgagttcggaccggacggggtacccgaacttttaccccaaacctacgttaccctacccgaaacggaacgggaaacccaaacccgggtaaccaaaacgtaaccctttacccccgtaagttaacgttaacttacggggaaacgtaaaaccgttggggaaaccccaggtaccccgtaaagggtaacgggtaaacgggttacccggaaaacggggaacccgtacggggaacctttaaagtttcgggttaaatttttaaccgttggggttccgggggaaccgggggtttcgggggacgggttcgggggggggaacccgggggtaaggttaaccggaaacgggtccggggaccgggggttaaccgggggaacccggggttaaaaccccggggg

SEQ ID NO: 374454 - DNA, 606 bp, Homo sapiens
  misc_feature: GZ8MTXP01A0HUV.21.19.B08.1.454.CMB.2.raw
  modified_base (383)..(383): a, c, t, g, unknown or other
  modified_base (404)..(404): a, c, t, g, unknown or other
  modified_base (412)..(412): a, c, t, g, unknown or other
  modified_base (565)..(565): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtcgggggtccctgagactctcctgtgcagcctctggactcccgccttcacgtacctatagtatgaattggactccgcgaggcctccgaagggaaggggctggagtggctctcacagtagttagtaggtagtagttagttcatatataacgcaagactnagtcgcgacgggctactcacntcacaganaccacgacaaagtacttcccagtactcgacgaacaaacgtcggaacctagtcccgtaggaacggtaacggaccggaagggacctacggtcttaagtgtttaccgttacggttgggtcgggcgggggttacgggcggttacggggggcgggtancggacggagggttccgggttcggggcccgtaaacccggggg

SEQ ID NO: 374455 - DNA, 654 bp, Homo sapiens
  misc_feature: GZ8MTXP01CBKIY.21.19.B08.1.454.CMB.2.raw
  modified_base (402)..(402): a, c, t, g, unknown or other
  modified_base (558)..(558): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctggttttcctagttactatttagaagtgtccagtgtgagtgcatctggtggagtcgtggggagcctggtcaagccgtggggactcccgtgagtacctctcctgtcgcacgtccctcgtggacctcccggtccttacacgtacctagtagttatgaagtttggactccgcgacggctaccgaagggaaaggggctggagtggcttctacgactaggtattaggtaggttaacgtagttagttctaatagttaaacttacgngagtacctcgagtcgacgacggggacctattaccaccgtactcctaccgaagaccgaaccaaacgtacccgaaacgttaccttcccgttgtaaccgttccgtaggaactaaagttcggaacacgccttggaacgacgtacgaaaggcctaccggtntacgttgtaaacgttccgttagggcgggttacggggttcgggcggttaagggggacgtaagtcgggaccgagggttccgggaacggggaaccccgg

SEQ ID NO: 374456 - DNA, 670 bp, Homo sapiens
  misc_feature: GZ8MTXP01AV9YS.21.19.B08.1.454.CMB.2.raw
  modified_base (373)..(373): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaaggccgtgggggtccctgagactctcctgtgcagcctctggatcccgccttcagtacccatagtatgaattggatcccgcaggcctccgaggaaaggggctggagtggcctctcacagtattagtggtagtagtagtttacatatataacgcngactcagtgacgagggccgtattcacctatctaccgaagacgaaccaacggacctaaacggtaactttccccgtaggtaaacttcctacggggtaaacctaaaagttcgggaacccgaacggtcccgttaagggacgtaaacgggttccggtaaacggggaaccgtaaccggggccttaaaggttacggttaactttaaccggttgggtaacgggtcgggggttggttccggggttaggggggccggggtagtccgggacgacgggttccgggtaacggggcccggtaacccggggg

SEQ ID NO: 374457 - DNA, 692 bp, Homo sapiens
  misc_feature: GZ8MTXP01DKS4J.21.19.B08.1.454.CMB.2.raw
  modified_base (644)..(644): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatcgtggtggagtcgtgggggagctggtcaagcgtgggggtccctgagactctcctgtgcagcctctggactcccgcttcagtacctatagtatgtaatggactccgcgaggctaccgaagggaacgggcgtaggagtcggtctctcaacgagtagttaggtggtaagttagttagtttacaattatacttaacgactaagtactcgagtcgcgaacgggggtacctacttaccaaccctattacccgtaccgaaaggaaccaaacgaaacccgaccgaaaacgtaaccgtttaccccgttagtacgttcttaacgggaactaaaacgtcgggaaaccacggtaccctagggaacgtaacgggtaccggaaacgggaacccgacgggtaccttaaagttagttaatttacgttgggtcggggtcgggttcggggttcgggttcggggggaagggngttaacggaaggtacggcgggttccgggggaacccgtaaacccggggg

SEQ ID NO: 374458 - DNA, 711 bp, Homo sapiens
  misc_feature: GZ8MTXP01ENGI0.21.19.B08.1.454.CMB.2.raw
tcagtcgtcgctcgcacgaccggtgctcgatttagtgagtcagtaagggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtggggagcctggtcaagccgtgggggtccctgagactctctgtgcacgcctctggactcccgtcttcagtaccatagtatagaattggactccgaccgagcctacgaagggaaaggggctagggagtcgggctccacacgagtagttaggtaggtagttaagttaggtttacagttatacgttaacgactaacggtaactcgtaagtcgaccggtacggggacgttaacttacccaacctacgttcccgaaccgaaggtaaaccggaaaccgaaaacccggaaccctaaagtaaaccctttccccgtaggttaacttccgtagggaaacctaaaggtacgaacgaccgtacgtacgggaagtaacggtacggaaacggaccgtacggcttaaggttccgttaagtttaccgttggggtcgggtcgggggcggttcgggggaccgggggtaacgggggactcgggaaccgaggggttccgggttcccggggaacccggttaaacccggggg

SEQ ID NO: 374459 - DNA, 511 bp, Homo sapiens
  misc_feature: GZ8MTXP02FPHET.21.19.B08.1.454.CMB.2.raw
  modified_base (443)..(443): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctggagtggctctcacagattagtggtagtagtagtttcatatattacgcagactcagtgcagggccgattcacatctccagagacaacgccaaagaattccctgtatctgcaaatggacagcctgagngtcgagacacggctatgtattactgtgcgggtgctgggggcgggatggacaggctggggccaacgggg

SEQ ID NO: 374460 - DNA, 555 bp, Homo sapiens
  misc_feature: GZ8MTXP02H6YX5.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtacctatagtatgaattggatccgccaggctccgaggaaaggggctggagtggctcgtcacagattaggtggtagtagtagtttcatatattacgcagactcagtgcaggggccattccaccatctaccagagaacaacgaccaagaaacttcccagtaatctagactaaaagtcgggacagccctaggaagtagtcggaaggacacgggactagtgttaattactggtcgcggggtggcgtgggggcgggagtacgacgaggcgtacggggaccgaacgggg

SEQ ID NO: 374461 - DNA, 507 bp, Homo sapiens
  misc_feature: GZ8MTXP02FKT6J.21.19.B08.1.454.CMB.2.raw
  modified_base (416)..(416): a, c, t, g, unknown or other
  modified_base (466)..(466): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctggagtggctctcacagattagtggtagtagtagtttcatatattacgcagactcagtgcagggccgattcacatctcagagacaacgccaaagattcccngtatctgcaaatggacagcctgagagtcgaggacacggctatgtattacngtgcgggtgcgtgggggcggatgacagcgtggggcaacggg

SEQ ID NO: 374462 - DNA, 517 bp, Homo sapiens
  misc_feature: GZ8MTXP02IGVZH.21.19.B08.1.454.CMB.2.raw
  modified_base (477)..(477): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactatttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctgcagtggctctcacagattagtggtagtagtagtttcatatattacgcagactcagtgcaggggccattcaccatctacagagacaacgccaaagacttccctagtactctagacaaatggaacagcctagagagtcgaggacacggactatgtacttacgngtgcgggtgcggtggggcgggatggacagcgtggggaccg

SEQ ID NO: 374463 - DNA, 529 bp, Homo sapiens
  misc_feature: GZ8MTXP02I5P60.21.19.B08.1.454.CMB.2.raw
  modified_base (339)..(339): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccgaggaaaggggctggagtggctctcacagattagnggtagtagtagttcatatattacgcagactcagtgcaggggccgattccaccatcctccagagacaacgccaaagacttccctgtatctgacaaatggacagcctagagagtacgagacacggctagtgtaattactggtagcggggtgccggtggggaacgggatcgacgtgcgtaggggccaacgggg

SEQ ID NO: 374464 - DNA, 517 bp, Homo sapiens
  misc_feature: GZ8MTXP02HPKBN.21.19.B08.1.454.CMB.2.raw
  modified_base (363)..(363): a, c, t, g, unknown or other
  modified_base (395)..(395): a, c, t, g, unknown or other
  modified_base (412)..(412): a, c, t, g, unknown or other
  modified_base (480)..(480): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctcgaggaaagggctggagtggctctcacagattagtggtagtagtagtttcatatattacgnagactcagtgcgagggccatcacatcacaganacaacgcaagacttccngtatctgactaaagtggacagacctgagagtcgaggacacggctatgtattacgtgtcgcggggtcgnggtggggaacggggatcggacagcgtcgggacacggg

SEQ ID NO: 374465 - DNA, 540 bp, Homo sapiens
  misc_feature: GZ8MTXP02H6V0O.21.19.B08.1.454.CMB.2.raw
  modified_base (418)..(418): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctggagtggctctcacagattagtggtagtagtagtttcatatattacgcagactcagtgacagggccattcacatctccagagacaacgacaagaacttcccngtatctgacaaatggacagcctagagagtacgaggacacggactagtgttattacgtaggtcggcggggtggccggtgggggcggggtagtcggacgaggccggtgggggacccgaacgggg

SEQ ID NO: 374466 - DNA, 558 bp, Homo sapiens
  misc_feature: GZ8MTXP02IAV9D.21.19.B08.1.454.CMB.2.raw
  modified_base (374)..(374): a, c, t, g, unknown or other
  modified_base (524)..(524): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctgtggagtctgggggagcctggtcaagccgtggggggtccctgagactctcctgtgcagcctctggatcccgtccttcagtacctatagtatgaattggatccgccaggcctccgaggaaaggggctaggagtggctctcacagattagtggtagtagtagtttcatatattacgcagactnagtgcgagggcatccacatctaccagagacaacgacaaagtaacttccctagtactctagactaaagtggacagcctaggagaggtcgaggacacggctaagtgttattacgtaggtgggtcggggcggtcgggtagggggcgggtacgnggaacgggacggccggtacggggaccggaacggg

SEQ ID NO: 374467 - DNA, 552 bp, Homo sapiens
  misc_feature: GZ8MTXP02HMM4X.21.19.B08.1.454.CMB.2.raw
  modified_base (258)..(258): a, c, t, g, unknown or other
  modified_base (397)..(397): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctntggatccgccttcagtacctatagtatgaattggatccgccaggctccgaggaaaggggctaggagtggctctcacagattagtggtagtagtagttcatatattacgcagactcagtgcgaggcatcacatctcaganacacgccaagacttccctgtatctgactaaagtgacagcctaggagagtcgagacgacggactatcggttattacgtggtcgtcggggtcggtacggtgggggaaccgggggtatacgggacgaaggtccggtacgggggtaccaaacccggggg

SEQ ID NO: 374468 - DNA, 529 bp, Homo sapiens
  misc_feature: GZ8MTXP02JYYKW.21.19.B08.1.454.CMB.2.raw
  modified_base (512)..(512): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccgaggaaaggggctggagtggctctcacagattagtggtagtagtagtttcatatattacgcagactcagtgcagggccattcaccatcctccagacgacaacgccaaagaacttccctgtaatctgacaaatcggacagcctagagagtcgaggacacggctatcgtattacgtggtcggcgggtgcgtgggggcgggtatcggacgnggcggcgggaccgacgg

SEQ ID NO: 374469 - DNA, 506 bp, Homo sapiens
  misc_feature: GZ8MTXP02J0UZB.21.19.B08.1.454.CMB.2.raw
  modified_base (364)..(364): a, c, t, g, unknown or other
  modified_base (397)..(397): a, c, t, g, unknown or other
  modified_base (440)..(440): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtacctatagtatgaattggactccgccaggctccaggaaggggctggagtggctctcacagattagtggtagtagtagtttcatatatacgnagactcagtgcaggggccattcacatctcaganacacgcaagacttccctgtatctgacaaatggacagcctgagngtcgagacacggctatgtatactggtcgcgggtgcgtggggcggatcgacagcgtacgggcacggg

SEQ ID NO: 374470 - DNA, 539 bp, Homo sapiens
  misc_feature: GZ8MTXP02HN2SQ.21.19.B08.1.454.CMB.2.raw
  modified_base (366)..(367): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgccaggctccgaggaaaggggctggagtggctctcacagattagtggtagtagtagttcatatattacgnngactcagtgcgagggccgattcaccatctccagagaacaacgacaaagtaacttccctgtatctagacaaatggacagcctgagacgtcgaggacacggctatgtatacgtggtggtcgggtggcgtgggggaacggagtggacgaggtcggtcgggggaccgtaaccgggg

SEQ ID NO: 374471 - DNA, 546 bp, Homo sapiens
  misc_feature: GZ8MTXP02FV9CI.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtacctatagtatgaattggatccgcaggctccaggaaaggggctggagtggctctcacagattagtggtagtagtagttcatatattacgcagactcagtgcaaggggcctattccaacctatcctaccagacgacaacgaccaaagaacttccctgtactcctgacaaagtgacagccgtagagagtcggagacgacggctagtgtattacgtggtcgcggggtgcggtgggggcgggagtggacgaggtcggtacgggggacgtaaccgggg

SEQ ID NO: 374472 - DNA, 522 bp, Homo sapiens
  misc_feature: GZ8MTXP02JETJP.21.19.B08.1.454.CMB.2.raw
  modified_base (364)..(364): a, c, t, g, unknown or other
  modified_base (393)..(393): a, c, t, g, unknown or other
  modified_base (468)..(468): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccgaggaaaggggctggagtggctctcacagattagtggtagtagtagttcatatatacgcngactcagtgcgagggccgattccacatcnccagagacacgcaagaactccctgtatctgacaaatggacagcctgagagtcgaggacaggctagtgtattacgngtcggcggtggcgtgggggcgggatcggacgtgcggtcggggaccgtaacgggg

SEQ ID NO: 374473 - DNA, 525 bp, Homo sapiens
  misc_feature: GZ8MTXP02ITVWU.21.19.B08.1.454.CMB.2.raw
  modified_base (462)..(462): a, c, t, g, unknown or other
  modified_base (478)..(478): a, c, t, g, unknown or other
  modified_base (489)..(489): a, c, t, g, unknown or other
  modified_base (495)..(495): a, c, t, g, unknown or other
  modified_base (500)..(500): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggatccgccaggctccgaggaaggggctggagtggctctcacagattaggtgtagtagtagttcatatattacgcagactcgagtgcgagggcctattcaccatctcagagaacaaccgaccaaagaacttccctgtatctgactaaatggacagcctgagagtcgagacncggctatgtattacgnggtcggcgggngtcggnggggnggatacgacaggctcgggacgacgg

SEQ ID NO: 374474 - DNA, 541 bp, Homo sapiens
  misc_feature: GZ8MTXP02HDDJF.21.19.B08.1.454.CMB.2.raw
  modified_base (419)..(419): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtggggggtccctgagactctcctgtgcagcctctggatccgccttcagtacctatagtatgaattggatccgccaggctccgaggaaaggggctggagtggctctcacagattagtggtatagtagttcatatattacgcagactcagtgcagggccgattcacatctacagacgacaaccgcaaagacttcccngtactctagacaaagtcggaacagcctaggacgagtacgaggacacggcttaagtgtacttacgaggttcggcggggttggcgtgggggcgggtatggacgagcggtcggggaccaacgggg

SEQ ID NO: 374475 - DNA, 522 bp, Homo sapiens
  misc_feature: GZ8MTXP02FM4OQ.21.19.B08.1.454.CMB.2.raw
  modified_base (365)..(365): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctggagtggctctcacagattagtggtagtagtagtttcatatattacgcngactcagtgcagggccgattcaccatctccagagacaacgccaaagacttccctgtatctgacaaatggacagcctgagagtcgaggacacggctaatgtatactggtgcgggtggcgtgggggcgggagtcgacgaggcgtacggggccaacgggg

SEQ ID NO: 374476 - DNA, 553 bp, Homo sapiens
  misc_feature: GZ8MTXP02HWXPY.21.19.B08.1.454.CMB.2.raw
  modified_base (362)..(362): a, c, t, g, unknown or other
  modified_base (392)..(392): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggaggcctggtcaagcctgggggtccctgagactctcctgtgcagcctctggatccgcctttcagtacctatagtatgaattggatccgcaggctcgaggaaagggctggagtggctctcacagattagtggtagtagtagtttcatatattacgnagactcagtgcgagggcctatccactatcncagacgacaaccgcaaagacttccagtatctagacaaaagtcgggacacgaccgtgaacgagtcggaggaacacgggactaagtgttaattacgtggtcggccggggtggcgtacgggggaacgggtagtcggacgtacggcgtcgggggaccaacggggg

SEQ ID NO: 374477 - DNA, 534 bp, Homo sapiens
  misc_feature: GZ8MTXP02JSPGK.21.19.B08.1.454.CMB.2.raw
  modified_base (423)..(423): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccgaggaaaggggctggagtggctctcacagattagtggtagtagtagtttcatatattacgcagactcagtgcaggggccgattccaccatctccagagacaacgacaaagacttacccngtatctgacaatggacagcctgagagtcgagacacggactatgtattacgtggtcgtcggggtggcggtgggggcggggagtcggacgaggcgtcgggggaccaacggggg

SEQ ID NO: 374478 - DNA, 587 bp, Homo sapiens
  misc_feature: GZ8MTXP02IBXB3.21.19.B08.1.454.CMB.2.raw
  modified_base (371)..(371): a, c, t, g, unknown or other
  modified_base (378)..(378): a, c, t, g, unknown or other
  modified_base (412)..(412): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggactcccgccttcagtacctatagtatgaatggatccgccaggctccgaggaaaggggctggagtggctctcacagtattaggtggtagttagtagtttacatatattacgnagtactnagtgacgaggggcctattcacccatcctacaganaacaacgctaaagaacttccctagtactctagactaaagtggaacagcctagaacgtacgtcgaaggacgacggtactagtagttaattacgtaggtcggtccgggggttggacgttcggggggaacggggacgttggaacccggaggtccggtacgggggaccgaacccggggg

SEQ ID NO: 374479 - DNA, 541 bp, Homo sapiens
  misc_feature: GZ8MTXP02FUNDC.21.19.B08.1.454.CMB.2.raw
  modified_base (419)..(419): a, c, t, g, unknown or other
  modified_base (521)..(521): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtggggggtccctgagactctcctgtgcagcctctggatccgccttcagtacctatagtatgaattggatccgcaggctccgaggaaaggggctggagtggctctcacagattagtggtagtagtagtttcatatattacgcagactcagtgcgagggccgattcacatctccagagacaacgcaaagacttcccngtatctgacaaagtggaacagcctagagacgtcggaggacgacggctaagtgtaattacgtggtcggcggggtggcggtgggggcggggtagtcggaacggnggcggtcggggaccgacggg

SEQ ID NO: 374480 - DNA, 551 bp, Homo sapiens
  misc_feature: GZ8MTXP02GXJBH.21.19.B08.1.454.CMB.2.raw
  modified_base (534)..(534): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcctggggggtccctgagactctcctgtgcagcctctggatccgccttcagtacctatagtatgaattggatccgccaggctccgaggaaaggggctggagtggctctcacagattaggtggtagtagtagtttcatatattacgcagactcagtgcagggccgtattcacctatctccagaacgacaaccgcaaagaacttccctagtactctagactaaaagtcggaacacgcctagaacgagtacggaggaacgacggtactagtgttaattacgtggtggcggggtgcggtgggggcgggatggacggnggcggtcgggacgacgg

SEQ ID NO: 374481 - DNA, 542 bp, Homo sapiens
  misc_feature: GZ8MTXP02JW2NM.21.19.B08.1.454.CMB.2.raw
  modified_base (366)..(367): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtacctatagtatgaattggatccgccaggctccgaggaaaggggctggagtggctctcacagattagtggtagtagtagtttcatatattacgnngactcagtgcagggccgtattcacccatctccagacgacacgccaaagactccctgtatctacgacaaagtggacagcctgagagtcgagacacggctagtagtattacgtggtacggtcgggtacggcgtagggggcggtagtcggacgaggcgtcgggggacctaaccggggg

SEQ ID NO: 374482 - DNA, 616 bp, Homo sapiens
  misc_feature: GZ8MTXP02G2YSK.21.19.B08.1.454.CMB.2.raw
  modified_base (584)..(584): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggtttcctagttactattttagaaggtgtccagtgtgaggtgcatctggtggagtcgtggggagcctggtcaagccgtgggggtccctgagactctcctgtcgcagcctcgtggactcccgccttcacgtacctatagtatagaagttggactccgcgaggcctaccggaagggaaagggctaggagtcggctctacactagtagttaggtaggttagtagttagttacaattatattacgactagacctgagtcgacgacgggacctataccaacctattccaccgagaacgaacaaacgaccaaagtaaccttcccgtagttactccgtagaacgtaaagtcgaacgagaccgtagacgtacgacggaacggacgacggtattaagtacgttaaattacgtgggtacgggtggggcgggtcggtcgggggaacggtanacggacgaggccggacgggaccgaaaccgggg

SEQ ID NO: 374483 - DNA, 583 bp, Homo sapiens
  misc_feature: GZ8MTXP02GVJQN.21.19.B08.1.454.CMB.2.raw
  modified_base (340)..(340): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtggggggtccctgagactctcctgtgcagcctctggatcccgccttcagtacctatagtatgaattggatccgccaggctccgaggaaggggctggagtggctctcacagattagnggtagtagttagttcatatattacgcagactcagtgcgagggccattcacatctcagacacaacgcaaagaacttccctagtactctagactaaagtcgggaacagacccgttagaacgaggtacgagggaccacggggtcttaagtcgttattaccgtggtcggtccgggggttggccggttggggggaaccggggtatacgggaacgtacggccggttacgggggacccgtaaaccggggg

SEQ ID NO: 374484 - DNA, 522 bp, Homo sapiens
  misc_feature: GZ8MTXP02IJYXM.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccgaggaaggggctggagtggctcgtcacagattagtggtagtagtagtttcatatattacgcagactcagtgcagggccattcacatctcagagacaacgcaagtaacttccctagtatcctagactaaatggacagcctagacgagtcgagacacgctatgtatacgtgtcggcgggtggcgtgggggcggtatcggacagcgtacggggccaacggg

SEQ ID NO: 374485 - DNA, 560 bp, Homo sapiens
  misc_feature: GZ8MTXP02F6A7U.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtacctatagtatgaattggatccgcaggctccaggaaaggggctggagtggctctcacagtatagtggtagtagtagtttcatatattacgcagactcagtgcgaggggccattcaccatctaccagagaaccaacgaccaaagtaacttcccagttactctagacaaagtcggaacagcctggaagtagtacggaggacacgggcttaagtcggtattacgtaggtcggcggggtggccgttgggggccggggtatacggacgaggcggtacggggctaaaccgggg

SEQ ID NO: 374486 - DNA, 512 bp, Homo sapiens
  misc_feature: GZ8MTXP02HJCVF.21.19.B08.1.454.CMB.2.raw
  modified_base (340)..(340): a, c, t, g, unknown or other
  modified_base (366)..(366): a, c, t, g, unknown or other
  modified_base (398)..(398): a, c, t, g, unknown or other
  modified_base (417)..(417): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtaccctatagtatgaattggatccgccaggctccaggaaaggggctggagtggctctcacagattagnggtagtagtagtttcatatattacgnagactcagtgcagggccattcacatctcaganacaacgcaaagacttcccngtatctgacaaatggacagcctgagagtcgagacacggctatcgtatactgtcgcgggtgcgtgggggcggatcgacgagcgtcggggcaacggg

SEQ ID NO: 374487 - DNA, 577 bp, Homo sapiens
  misc_feature: GZ8MTXP02GV9A7.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtggggggtccctgagactctcctgtgcagcctctggatccgccttcagtacctatagtatgaattggatccgcaggctccgagggaagggctggagtggctctcacagtattaggtggtagtagttagtttcatatattacgcagactcagtgcgagggccattccactatcctaccagacgacaaccgaccaaagtacttccctagtactctgactaaagtcgaacacgcctgaagacgtacgaaggaccaggtacttagtacgttaattcgtggtacggcggggttcggcggtgggggaacgggggtaatcgggaacgacgggtccggtacgggggaccgtaaaccggggg

SEQ ID NO: 374488 - DNA, 569 bp, Homo sapiens
  misc_feature: GZ8MTXP02IPSPW.21.19.B08.1.454.CMB.2.raw
  modified_base (367)..(367): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgccaggctccgaggaaaggggctaggagtggctctcactgattagtggtagtagtagttcatatattacgnagactcagtgcgagggcctattccaccatcctccagacgacaacgaccaaagtaccttccctgtactctagactaaagtcggaacacgccctaggaacgacggtacggaaggaccacgggacttagtcgttattacgtggtcggccggggtggtcggtgggggcggggatcggacgaggccggtaggggccgtaaccggggg

SEQ ID NO: 374489 - DNA, 544 bp, Homo sapiens
  misc_feature: GZ8MTXP02F6WG9.21.19.B08.1.454.CMB.2.raw
  modified_base (425)..(425): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtggggggtccctgagactctcctgtgcagcctctggactccgccttcagtacctatagtatgaattggatccgccaggctccgaggaaaggggctggagtggctctcacagattagtggtagtagtagtttcattatattacgcagactcagtgcgagggccattccaccatctccagacgaacacgacaaagacttcccngtatctgacaaatcggacagcctgagagtcgaggacacggctagtagttattacgtggttcggcgggtggcggtgggggaacgggatcggacgaggtcgtacgggggccgtaaccgggg

SEQ ID NO: 374490 - DNA, 545 bp, Homo sapiens
  misc_feature: GZ8MTXP02I0X0M.21.19.B08.1.454.CMB.2.raw
  modified_base (463)..(463): a, c, t, g, unknown or other
  modified_base (520)..(520): a, c, t, g, unknown or other
  modified_base (528)..(528): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggactccgcaggctacgaggaaagggctggagtggctctcacagtattaggtggtagtagtagttcatatattacgcagtactcagtgcaggggcctatccaccatctcagacgacacgcaagtactcctgtactctagacaagtcggactacgctagagagtacgacgtanacggcttagtacgtatacgtgtacgggcgggtggcggtagggggcggatacggacgnggtccggnggggaccgtaacggggg

SEQ ID NO: 374491 - DNA, 522 bp, Homo sapiens
  misc_feature: GZ8MTXP02HYZ9J.21.19.B08.1.454.CMB.2.raw
  modified_base (366)..(366): a, c, t, g, unknown or other
  modified_base (371)..(371): a, c, t, g, unknown or other
  modified_base (450)..(450): a, c, t, g, unknown or other
  modified_base (474)..(474): a, c, t, g, unknown or other
  modified_base (490)..(490): a, c, t, g, unknown or other
  modified_base (495)..(495): a, c, t, g, unknown or other
  modified_base (505)..(505): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggagcctggtcaagccgtgggggtccctgagactctcctgtgcagcctctggatccgccttcagtacctatagtatgaattggatccgccaggctccgaggaaagggctggagtggctctacacagattaggtggtagtacgtagttcatatattacgcngactnagtgcagggcatcacatctaccagacgacaacgcaaagaaacttcccagtatctgactaaaatggaacagccgtagagngtacgaggcagctagtgtatacgngtcgggcggcggcggnggggnggagcgacgnggcggtcgggacgacgg

SEQ ID NO: 374492 - DNA, 604 bp, Homo sapiens
  misc_feature: GZ8MTXP02HI4PE.21.19.B08.1.454.CMB.2.raw
  modified_base (339)..(339): a, c, t, g, unknown or other
  modified_base (376)..(376): a, c, t, g, unknown or other
  modified_base (409)..(409): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggactcccgccttcacgtacctatagtatagaattggactccgccaggcctccgaagggaaaggggcgtaggagtggctcncacagtattagtggtagtagtagtttcatatatacgnagactcagtgcgagggaccgtatccaccactcncgagacgaacaccgacaaagtacttaccctagtactctagactaaagtggaaccagcccgtaggaacggacgtacggaacgggacacggtactaagttagttaattacgtgggtcgggcggggtacggtccgggtaggggggaacggggtagtacggacggtaggtccggtacgggggtacccgaaacccggggg

SEQ ID NO: 374493 - DNA, 526 bp, Homo sapiens
  misc_feature: GZ8MTXP02JZMJG.21.19.B08.1.454.CMB.2.raw
  modified_base (434)..(434): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaaggcctgggggtccctgagactctcctgtgcagcctctggatccgccttcagtacctatagtatgaattggatccgcaggctccgaggaaaggggctggagtcggctctcacagattagtggtagtagtagttcatatattacgcagactcagtgcgagggccgtattccacatcctaccagagacaaccgcaaagaacttccctagtatctanacaaatcggacaggcctgagagtcgaggacacggctatgtatacgtgtcgcgggtgcgtgggggcggatcggacagcgtaggggccaacggg

SEQ ID NO: 374494 - DNA, 796 bp, Homo sapiens
  misc_feature: GZ8MTXP02GJXSG.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgcccttcacgtacctatagtatgaattggactccgccaggcctaccgaagggaaaggggcgtagggaggtcgggctcgtacaacgagtagtttaggtaggttaaggtaacgttagtttactaattaattaagttaccgctacggtactacgtaaggttcgaccggacggggtaccgaatttcccaaccctacttaccctacccgaaggaaaccgaaaccgaaaccgacccgaaaaaggttaacctttacccccgtaggtttaaaccttccgttaaacggaacctttaaaaagtggggaaaccctaaacggaccccttagggaaaggttacggtaaccggggaacggaaaccgtaacggggtaccttaaaacgtttacgggttaaaagttttaccggttcggggttaagggggtcccggggggttaggggccccgggggtttacgggggggggaacgggggtaattacgggggaaaaccggtcgggggaccggggtttacgggggggaacccccgttaaaacccggggggg

SEQ ID NO: 374495 - DNA, 577 bp, Homo sapiens
  misc_feature: GZ8MTXP02I51QX.21.19.B08.1.454.CMB.2.raw
  modified_base (369)..(369): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctgggtcaagccgtggggggtccctgagactctcctgtgcagcctctggatcccgccttcagtacctatagtatgaattggactccgccaggctccgaaggaaaggggctggagtggctctcacagattagtggtagtagtagttcatatattacgntagactcagtgcgacggggcctattccactatccacaggacaacacgacaaagtacttccctagtatcgtagaactaaagtcggaacacgcctaggaagacggtacgacggtacgacggtctaagttacgtattacgtggtcggcggggttggcggtgggggaacgggtatcggacgacgggtcggtcgggggaacccgtaccggggg

SEQ ID NO: 374496 - DNA, 538 bp, Homo sapiens
  misc_feature: GZ8MTXP02HM844.21.19.B08.1.454.CMB.2.raw
  modified_base (338)..(338): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcctggggggtccctgagactctcctgtgcagcctctggatccgccttcagtacctatagtatgaattggatccgcaggctccgaggaaagggctggagtggctctcacagattagnggtagtagtagttcatatattacgcagactcagtgacgagggccgtattcaccatctccagagacaacgccaaagacttcccagtactctgactaaatgggacagcctagagagtcgaggacacggctatagtattactggtcgtcgggtggtcggtgggggcgggtatcggacgaggtcgacgggggaccgaaccgggg

SEQ ID NO: 374497 - DNA, 599 bp, Homo sapiens
  misc_feature: GZ8MTXP02HGQ6U.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggactccgccaggctaccgagggaaacggggctggagtggctctcacagtattagtggtagtagtagtttcatattattacgcagactcgagtgcgacggggcctacttccacctatcctacccgaagaacgaccaaaccgaccaaagtaacttccctagtaactctaggactaaagtcggaacagcctaggaacgtaggtacggaagaccgacggtacttagtagttattacgtggtacggtcggggtaggcggtggggggaacgggtatacggacgtacgcgggtacgggggaccgaacccggggg

SEQ ID NO: 374498 - DNA, 571 bp, Homo sapiens
  misc_feature: GZ8MTXP02G6R9V.21.19.B08.1.454.CMB.2.raw
  modified_base (388)..(388): a, c, t, g, unknown or other
  modified_base (391)..(391): a, c, t, g, unknown or other
  modified_base (396)..(396): a, c, t, g, unknown or other
  modified_base (414)..(414): a, c, t, g, unknown or other
  modified_base (419)..(419): a, c, t, g, unknown or other
  modified_base (535)..(535): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggatccgcaggctccgaggaaagggctggagtggctctcacagattaggtggtagtagtagtttcatatattacgcagctcagtgcagggcatcacntcncaganacaacgcaaagacttccngtacnctgactaaagtcggaacacgaccctggaagacgtacgggaaggaccaacgggctttaaagtcggtttaaacttccggtagtcggggtcgggggttggccggttgggggaacgggtntcggacgaggtccgggtagggggacccgaacggggg

SEQ ID NO: 374499 - DNA, 529 bp, Homo sapiens
  misc_feature: GZ8MTXP02I14J4.21.19.B08.1.454.CMB.2.raw
  modified_base (504)..(504): a, c, t, g, unknown or other
  modified_base (507)..(507): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtggggggtccctgagactctcctgtgcagcctctggatccgccttcagtacctatagtatgaattggatccgccaggctccgaggaaaggggctggagtggctcgtcacagattaggtggtagtagtagttcatatattacgcagactcgagtgcgagggcattcacctatctacagagacaacgcaaagacttccagtactctagacaaaatcgggaactagccgtagagagtacgacgacgacggactactagtattactgtcgcggtggcgtggggnggngacgacgagcgcggacggacgg

SEQ ID NO: 374500 - DNA, 532 bp, Homo sapiens
  misc_feature: GZ8MTXP02G4B6P.21.19.B08.1.454.CMB.2.raw
  modified_base (366)..(366): a, c, t, g, unknown or other
  modified_base (421)..(421): a, c, t, g, unknown or other
  modified_base (504)..(504): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtacctatagtatgaattggatccgcaggctccgaggaaaggggctggagtggctcgtcacagattagtggtagtagtagttcatatattacgcngactcagtgcagggccgtatcacatctccagacgacaacgccaaagaacttcccngtaactctagactaaagtggacagccctagagtagcggaaggacacggctagtgtattactggtggcgggtggcgtggggggngggaggcgacgaggcggcggacggacgg

SEQ ID NO: 374501 - DNA, 547 bp, Homo sapiens
  misc_feature: GZ8MTXP02JH63V.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccaggaaaggggctggagtggctctcacagattagtggtagtagttagttcatatattacgcagactcagtgcagggccgattcacatctccagagacaacgacaaagaacttaccctgtatctagacctaaagtggacaacgccgtagagtacgtacgaggacacgggcttagtgtaattacgtgtcggcggggtggcgttagggggccgggtatacggacgaggcggtcggggacgaacgggg

SEQ ID NO: 374502 - DNA, 544 bp, Homo sapiens
  misc_feature: GZ8MTXP02JVBED.21.19.B08.1.454.CMB.2.raw
  modified_base (366)..(366): a, c, t, g, unknown or other
  modified_base (506)..(506): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgccaggctccgaggaaaggggctggagtggctctcacagattagtggtagtagtatttcatatattacgnagactcagtgacgagggccattcaccctatcctccagacgacaacgaccaaagtaacttccctgtactctagacaaagtgacagcctgagacgtcgacggacacgctatgttatacgtgcggtcggggtggcgtgggggnggggagtcggacgacgcggtcgggggccgtaaccgggg

SEQ ID NO: 374503 - DNA, 590 bp, Homo sapiens
  misc_feature: GZ8MTXP02FX6HQ.21.19.B08.1.454.CMB.2.raw
  modified_base (367)..(367): a, c, t, g, unknown or other
  modified_base (546)..(546): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcctggggggtccctgagactctcctgtgcagcctctggatcccgccttcagtacctatagtatgaattggatccgccaggctccgagggaaaggggctggagtggctctcacagattagtggtagtagtagttcatatattacgnagactcagtgacaggggccattccacctatctaccagagaccaaacgacccaaagaacttccctagtaactcgtagacaaaagtcgggaacacgaccctggaacgtacggtacggaaggaaccgacgggtctaaagttgttaactttacgtggtcgggcggggtgggcggttcgggggnggggtatcggaacggcggtcggtacgggggccgtaaaccggggg

SEQ ID NO: 374504 - DNA, 514 bp, Homo sapiens
  misc_feature: GZ8MTXP02FXJ7S.21.19.B08.1.454.CMB.2.raw
  modified_base (417)..(417): a, c, t, g, unknown or other
  modified_base (443)..(443): a, c, t, g, unknown or other
  modified_base (453)..(453): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgcaggctccaggaaaggggctggagtggctctcacagattagtggtagtagtagtttcatatattacgcagactcagtgcagggccattcacatctccagagacaacgccaaagaacttcccngtatctgacaaatggacagcctgagngtcgaggacncggctatgtattacgtgtgcgggtgcgtgggggcggatggacgagcgtcggggcgaacggg

SEQ ID NO: 374505 - DNA, 550 bp, Homo sapiens
  misc_feature: GZ8MTXP02HM7OE.21.19.B08.1.454.CMB.2.raw
  modified_base (425)..(425): a, c, t, g, unknown or other
  modified_base (458)..(458): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggatccgcaggctccgaggaaaggggctggagtcggctctcacagattagtggtagtagtagtttcagtatattacgcagactcagtgcagggccattcaccatctccgagagacaacgacaaagaacttcccngtatcttagactaaagtggacacgcctaggagnggtcgaggacgacggctaagtgtattacgtggtggcggggtcgcggtgggggcggggaggtaggacgacggcggtcggggacggaaccgggg

SEQ ID NO: 374506 - DNA, 569 bp, Homo sapiens
  misc_feature: GZ8MTXP02G4SAI.21.19.B08.1.454.CMB.2.raw
  modified_base (375)..(375): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggatccgccaggctccgaggaaagggctggagtggctctcacagattagtggtagtagttagtttcatatagttacgcagtctnagtgactacgggccgtatcccgacatctaccagacgaaccaaccgaccaaaggtacttcccgtagtactctagactaaagtcggactacgcctagacggtagtacggagacgacggctagtacgtattaccgtgggacgtcggggtcgcggttgggggcggtatacggactaggcgtacggggactaaccgggg

SEQ ID NO: 374507 - DNA, 520 bp, Homo sapiens
  misc_feature: GZ8MTXP02JYRCD.21.19.B08.1.454.CMB.2.raw
  modified_base (401)..(401): a, c, t, g, unknown or other
  modified_base (496)..(496): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtacctatagtatgaattggatccgccaggctccgaggaaaggggctggagtggctctcacagattagtggtagtagtagtttcatatattacgcagactcagtgcgagggccattcaccatctccaganacaacgcaaagacttcccagtatctgacaatggacagcctgagagtcgaggacacggctatgtatactggcggcgggtcggcgtgggggcggtangacgagcggtcggggccaacgggg

SEQ ID NO: 374508 - DNA, 522 bp, Homo sapiens
  misc_feature: GZ8MTXP02FY6EZ.21.19.B08.1.454.CMB.2.raw
  modified_base (361)..(362): a, c, t, g, unknown or other
  modified_base (393)..(393): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgcaggctccgaggaagggctggagtggctctcacagatagtggtagtagtagtttcatatattacgnngactcagtgcagggccatcacatctccaganacacaccaagtacttcctgtatcgtagacaaatcggacagcctgagagtcgagacgacgctagtgtattacgtgtggcggggtcgcggtgggggcgggagtcggacgaggcggtcggggacaaccgggg

SEQ ID NO: 374509 - DNA, 557 bp, Homo sapiens
  misc_feature: GZ8MTXP02GOXBB.21.19.B08.1.454.CMB.2.raw
  modified_base (367)..(367): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggtttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggatccgccaggctccgagggaaaggggctggagtggctctcacagtattagtggtagtagtagttcatatatacgnagactcagtgcgagggccattcactatcctacagagaacaacgaccaaagaacttccctagtaactctagacaaaagtcgaacagacctgaagtaggtacgaggaacgacggtctaagttgtaattacgtgtcggcgggttggcggtgggggcgggtatcggacaggcggtcgggggacgtaaaccgggg

SEQ ID NO: 374510 - DNA, 553 bp, Homo sapiens
  misc_feature: GZ8MTXP02FNZWI.21.19.B08.1.454.CMB.2.raw
  modified_base (366)..(367): a, c, t, g, unknown or other
  modified_base (372)..(372): a, c, t, g, unknown or other
  modified_base (505)..(505): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggatccgcaggctcgaagggaaggggctggagtggctctcacagattagtggtagtagtagtttcatatatacgnngactnagtgcaggggcctattccaccatcctacaagacgacaaccgaccaaagaacttccctagttactctagacaaaagtggaacagcctgagagtcgaggacacggctatagttatacgtggtaggcggggtcggnggtgggggaacgggtataggacgaggcggacgggggccgaaacggggg

SEQ ID NO: 374511 - DNA, 557 bp, Homo sapiens
  misc_feature: GZ8MTXP02JXOU0.21.19.B08.1.454.CMB.2.raw
  modified_base (369)..(370): a, c, t, g, unknown or other
  modified_base (398)..(398): a, c, t, g, unknown or other
  modified_base (533)..(533): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggatccgccaggctccgaggaaggggctggagtggctctcacagtattagtggtagtagtagtttcattatattacgnngactcagtgcgagggccgtattccaccntctccagacgacaaccgaccaaagtaacttcccagttactctagacaaagtcggacagcctagagtacgtcgaggacacggacttagtgttatacgtggtcggacgggtggccggtgggggcggggatcggacgnggcggtacggggacctaaccgggg

SEQ ID NO: 374512 - DNA, 529 bp, Homo sapiens
  misc_feature: GZ8MTXP02HLD23.21.19.B08.1.454.CMB.2.raw
  modified_base (420)..(420): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtaccctatagtatgaattggatccgccaggctccgaggaaaggggctggagtggctctcacagattagtggtagtagtagtttcatatattacgcagactcagtgcagggccgattccacatctcagagacaacgccaagaacttccngtatctgactaaatggactagcctgagagtcgaaggacacggctatcgtattacgtgtggcgggtggcggtgggggcgggatcggacgaggcgtcggggacgaccgggg

SEQ ID NO: 374513 - DNA, 518 bp, Homo sapiens
  misc_feature: GZ8MTXP02HCIXB.21.19.B08.1.454.CMB.2.raw
  modified_base (393)..(393): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgcaggctccgaggaaaggggctggagtggctctcacagattagtggtagtagtagtttcatatattacgcagactcgagtgcagggccgattcacatcncagagacaacgcaaagaacttccagtatctgacaaagtggacagcctgagagtcgagacacggctatgtattacgtgtggcgggtgcggtgggggcggagtcggacaggcgtaggggccaacggg

SEQ ID NO: 374514 - DNA, 584 bp, Homo sapiens
  misc_feature: GZ8MTXP02JF3CG.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtacctatagtatgaattggatccgccaggctccgaggaaaggggctggagtggctctcacagattagtggtagtagtagtttcatatattacgcagactcagtgcgagggccgattaccaccactccccagacgaacaacgccaaagtaacttccctagtaactcagtacaaagttggacaggaccctaggacgacggtacggaggaacgacggtactaagtgttaattaccgtggtgggccggggtgggccggtgggggacggggtaagcggtaacggcggcggtacgggggccgaacggggtaaccccgg

SEQ ID NO: 374515 - DNA, 631 bp, Homo sapiens
  misc_feature: GZ8MTXP02F2C00.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggactccgccttcagtacctatagtatgaattggatccgcaggctccgagggaaagggctggagtggctctcacagattagtggtagtagtagttcatatatacgacagactcagtgcgagggcctattccaccactcacgagacgaacacgacaaagtaccttccgtattactctagaactaagtacgaacgacgtaccgaggaacggtacggtaacggacggaaacccgtaggtaccgttaaacgttaggtttaaaccttacggttgggtaccggggtcgggggttaccggccgggggttaggggggaaccggggttaagtacggaaacggtacgggccggggttaccgggggacccgtaaaacccggggg

SEQ ID NO: 374516 - DNA, 510 bp, Homo sapiens
  misc_feature: GZ8MTXP02FEHI3.21.19.B08.1.454.CMB.2.raw
  modified_base (470)..(470): a, c, t, g, unknown or other
  modified_base (498)..(498): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgcaggctccgaggaaaggggctggagtggctctcacagtatagtggtagtagtagtttcatatattacgcagactcagtgcagggccattcaccatctcagagacaacgtccaaagattccctgtatctgacaaaatggacagcctgagagcgaggactacggctatgtattacgngtgcgggtggcgtggggcgggatgacgngcgcggcgacgg

SEQ ID NO: 374517 - DNA, 568 bp, Homo sapiens
  misc_feature: GZ8MTXP02HMK9Q.21.19.B08.1.454.CMB.2.raw
  modified_base (258)..(258): a, c, t, g, unknown or other
  modified_base (375)..(375): a, c, t, g, unknown or other
  modified_base (492)..(492): a, c, t, g, unknown or other
  modified_base (544)..(544): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctntggatccgccttcagtacctatagtatgaattggatccgccaggctaccgagggaaaggggctaggagtggctctcacagtattagtggtagtagttagtttcattatattacgacngactcagtgcgacgggccgattccacactctaccgagacgacaaccgaccaaagtaacttcccctagtattccttagacaaaagtggacagcccgtagaagagtacgaggacacggntatgtattacgtggtacggcgggtggcggtgggggaacgggagtacggacgnggcggtcggggaccgtaaccgggg

SEQ ID NO: 374518 - DNA, 605 bp, Homo sapiens
  misc_feature: GZ8MTXP02H6EF4.21.19.B08.1.454.CMB.2.raw
  modified_base (345)..(345): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggagcctggtcaagccgtggggggtccctgagactctcctgtgcagcctctggactcccgccttcagtacctatagtatgaattggactccgccaggcctaccgaggaaaggggctaggagtggctctcacagattagnggtagtagtagtttcatattattacgcagtactcagtgcgacggggctatccacattcaccagacgacaacgaccaaagaccttcccgtagtactctacgactaaagcggaacacgccgtaaggacgtacgacggaacggacgacgggacttaagtacgttacgttaaacgtggtacgggtcggggtcggtcgggttaacggggggccggggtatacgggacgacgggaccgggttacgggggacccggaaacccggggg

SEQ ID NO: 374519 - DNA, 569 bp, Homo sapiens
  misc_feature: GZ8MTXP02IO5IQ.21.19.B08.1.454.CMB.2.raw
  modified_base (332)..(332): a, c, t, g, unknown or other
  modified_base (340)..(340): a, c, t, g, unknown or other
  modified_base (366)..(366): a, c, t, g, unknown or other
  modified_base (398)..(398): a, c, t, g, unknown or other
  modified_base (474)..(474): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtcccctgagactctcctgtgcagcctctggatcccgccttcagtacctatagtatgaattggatccgccaggctccgaggaaggggctggagtggctctcanagattagnggtagtagtagtttcatatatacgcngactcagtgcaggggccattcacatcacaganacacgcaagtaacttccctgtactctagactaaagtggacagccgtagagagtacggagaccgacgggtcttaacnggttaacttacgttaggtcggtcgggggtcggtacggttgggggaaccgggggagttacggacgacggtcggtacgggggacccgtaaacggggg

SEQ ID NO: 374520 - DNA, 513 bp, Homo sapiens
  misc_feature: GZ8MTXP02FHKYB.21.19.B08.1.454.CMB.2.raw
  modified_base (396)..(396): a, c, t, g, unknown or other
  modified_base (469)..(469): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccgaggaaaggggctggagtggctctcacagatagtggtagtagtagtttcatatattacgcagactcagtgcagggccattcacatctcaganacaacgccaaagacttaccctgtatctgacaaatggacagcctagagagtcgaggacacggctatgtattacngtgcgggtgcgtgggggcgggatcgacagcgtcggggcaacggg

SEQ ID NO: 374521 - DNA, 609 bp, Homo sapiens
  misc_feature: GZ8MTXP02IYCOC.21.19.B08.1.454.CMB.2.raw
  modified_base (516)..(516): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatctggtggagtcgtgggggaggcctggtcaagccgtggggggtccctgagactctcctgtgcagcctctggactcccgccttcagtacctatagtatgtaattggatcccgcccgagggcctaccggaaggggaaaggggcgtgggagtcggctccgtcacagtagttaggtaggtagttagttagtttcatattattacgcagtactcagtgacgaggggacctattacccacctatcctacgaagacgaacaaccgactaaagtaacttcccagttactctagactaaagtcgacagccgtgaagcgtacggaggacacggtnttaacgtcttaagttcgtaggtcgggtcggggtcggtcgggtgggggaacggtagtcggacggcgggcgggtacgggggaccgtaaccggggg

SEQ ID NO: 374522 - DNA, 592 bp, Homo sapiens
  misc_feature: GZ8MTXP02GT8TS.21.19.B08.1.454.CMB.2.raw
  modified_base (371)..(371): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcctggggggtccctgagactctcctgtgcagcctctggactcccgccttcacgtacctatagtatgaatggatccgccaggcctccgaggaaaggggcgtggagtggctctcacagtatagtggtagtagtagttcatatattacgacngtactcagtgacgagggccgattccactatctaccagacgacaaccgacaaagtacttccctagtaactcgtagactaaagtggaacagaccctaggaacggacgtaccggaaggaccgaccgggtattaagtgttaattacgttgggtcggtacgggggtggccggttaggggggcgggggacggtaggacggacggcggtcggggaccggtaaccgggg

SEQ ID NO: 374523 - DNA, 605 bp, Homo sapiens
  misc_feature: GZ8MTXP02GAPPB.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgcaggctccgaggaaagggctggagtggctctcacgagtattagtggtagtagttagtttcattatattacgcagactcagtgcgagggccgtattccaccatctaccagaacgacaaccgaccaaagtacttccccgtagttaaacttctagacctaaaagtcgggaacacgccctaggacgtacggtacggaaggacacgggtacttaagttacgttaattacgtggtacggtcggggttcggccggttagggggccggggtaatcgggaaccgaggtccggtacgggggacccgtaaacccggggg

SEQ ID NO: 374524 - DNA, 558 bp, Homo sapiens
  misc_feature: GZ8MTXP02HTIOC.21.19.B08.1.454.CMB.2.raw
  modified_base (392)..(392): a, c, t, g, unknown or other
  modified_base (396)..(396): a, c, t, g, unknown or other
  modified_base (425)..(425): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggactccgccttcagtacctatagtatgaattggactccgccaggctccgaggaaggggctggagtggctctcacagattagtgtagtagtagtttcatatattaccgagactcagtgcgaggccatcacatcncagngaacacgcaaagacttcccagtatcgtanaactaagtgacagcgagagagacggagacgacgtactagtagttatacgtggtacgggcgggggtcggcggggtacgggggaacggggtacggtacggtacggacggtacgggtacggggaccgggaaccggg

SEQ ID NO: 374525 - DNA, 547 bp, Homo sapiens
  misc_feature: GZ8MTXP02JZ4XR.21.19.B08.1.454.CMB.2.raw
  modified_base (373)..(373): a, c, t, g, unknown or other
  modified_base (491)..(491): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtggggggtccctgagactctcctgtgcagcctctggatccgccttcacgtacctatagtatgattggatccgccaggctccgaggaagggctggagtggctctcacagattagtggtagtagtgtttcatatatacgctagactcagtncgagggcctattcacctatcctaccagaagaccaaacgccaaagtaacttcccctagtactctagacaaagtggaacagcctagagagtcggagaccgacggactagtgttattacgnggtcgccggggtggcgtgggggcgggatcgacgagcggtcggggacccgaacgggg

SEQ ID NO: 374526 - DNA, 521 bp, Homo sapiens
  misc_feature: GZ8MTXP02FLZJI.21.19.B08.1.454.CMB.2.raw
  modified_base (392)..(392): a, c, t, g, unknown or other
  modified_base (415)..(415): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccgaggaaaggggctggagtggctctcacagattagtggtagtagtagtttcatatattacgcagactcagtgcagggccattcacatcncagagacaacgcaagacttcccntatctgacaaatggacagcctgagagtcgaggacacggctaatgtattacgtggtgcggggtgcgtgggggcgggagtacgacgagcggtacgggggccaacgggg

SEQ ID NO: 374527 - DNA, 624 bp, Homo sapiens
  misc_feature: GZ8MTXP02I5Y49.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactcccgccttcagtacctatagtatgaattggatccgccaggctccgaggaaagggctggagtggctctcacagattagtggtagtagtagttcattatattacgcagactcagtgcgaggggcctattccacctatcctccgaagacgacaacgaccaaagtacttccctagtactctgacctaaagtcgggacctaagccctaggaacggtcggtacggaaggtaccgaacgggtcttaacggttacgtttaaattaccgtgggttacggggtccgggggttgggaccgggttcggggggaacggggtaagttcgggaacccggaagggccgggtacgggggaacccgtaaacccggggg

SEQ ID NO: 374528 - DNA, 535 bp, Homo sapiens
  misc_feature: GZ8MTXP02FUX0X.21.19.B08.1.454.CMB.2.raw
  modified_base (365)..(365): a, c, t, g, unknown or other
  modified_base (516)..(516): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtacctatagtatgaattggatccgcaggctccaggaaaggggctggagtggctctcacagattagtggtagtagtagtttcatatattacgcngactcagtgcagggccgattcaccatctaccagagacaacgccaaagacttccctgtactctgacaatggacagccctgacgagtacgaggacacggctagtgttattactggtaggcggggtggcgttgggggcggggtagaggaccggnggcggacgggaccgaacgg

SEQ ID NO: 374529 - DNA, 567 bp, Homo sapiens
  misc_feature: GZ8MTXP02JO51V.21.19.B08.1.454.CMB.2.raw
  modified_base (334)..(334): a, c, t, g, unknown or other
  modified_base (494)..(494): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgccaggctaccgaagggaaaggggctaggagtggctcncacagagttagtggtagtagttattcatatatacgcagactacgagtgcgacgggcctattacccactatcctaccagacgacaacgcaaagtaactccctagtatctagacaaatggaactagacctgagagtcgaggtacacggctagtgtattacgnggtacggtcggggtggcggtagggggaacggggtagtcgaacggcggtaccggtcgggggacctaaccggggg

SEQ ID NO: 374530 - DNA, 543 bp, Homo sapiens
  misc_feature: GZ8MTXP02JFSMI.21.19.B08.1.454.CMB.2.raw
  modified_base (481)..(481): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgcaggctccgaggaaggggctggagtggctctcacagattagtggtagtagtagtttcatatattacgcagactcagtgcgagggccgattcacatctcagagacacgacaaagacttccctagtactctagacaaagtggactagccgtagagacgtcggaggacacggctagtagtattacgnggtcggcgggtcggcgtgggggcgggggatcggacgaggccgtcgggggaccgtaaccgggg

SEQ ID NO: 374531 - DNA, 557 bp, Homo sapiens
  misc_feature: GZ8MTXP02HY40S.21.19.B08.1.454.CMB.2.raw
  modified_base (339)..(339): a, c, t, g, unknown or other
  modified_base (393)..(393): a, c, t, g, unknown or other
  modified_base (485)..(485): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggactccgccttcagtacctatagtatgaattggatccgcaggctccgaggaaagggctggagtggctctcacagattagnggtagtagtagtttcatatattacgcagctcagtgacgagggccattcacatcnccagacgacacgacaaagaacttccagtactctagactaaagtcggacacgctagagaggtacgaggacgacggcttaatggttaattacgnggtacggcggggtacggtcgggtagggggaacggggtatacggacgaggccggtacggggaccgtaacgggg

SEQ ID NO: 374532 - DNA, 565 bp, Homo sapiens
  misc_feature: GZ8MTXP02IX0AU.21.19.B08.1.454.CMB.2.raw
  modified_base (254)..(254): a, c, t, g, unknown or other
  modified_base (259)..(259): a, c, t, g, unknown or other
  modified_base (377)..(377): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctgggtggagtcgtgggggaggcctggtcaagccgtggggggtccctgagactctcctgtgcngcctntggatccgccttcagtacctatagtatgaattggactccgccaggcctccgagggaaaggggctggagtttggctctcacagtattaggtggtagtagtagtttcatattattacgcngactcagtgcgagggctattccacatctcagacgacaaccgcaaagtaacttccctagtatctagactaaatcggacacgcgtagaggtacgtacgaggaccacggtacttaacgtgttaattacgtggtcggcgggtgggtcggtaggggggcgggatggacgaggcgggtcggggaccgtaacggg

SEQ ID NO: 374533 - DNA, 574 bp, Homo sapiens
  misc_feature: GZ8MTXP02HP7DX.21.19.B08.1.454.CMB.2.raw
  modified_base (258)..(258): a, c, t, g, unknown or other
  modified_base (367)..(367): a, c, t, g, unknown or other
  modified_base (372)..(372): a, c, t, g, unknown or other
  modified_base (429)..(429): a, c, t, g, unknown or other
  modified_base (532)..(532): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctntggatccgccttcagtacctatagtatgaattggactccgccaggctccgaggaaagggctggagtggctctcacagattagtggtagtagtagttcatattatacgcngactnagtgcgagggctatccacatcctacagacgacaaccgcaaagtacttcccagtatcngactaaagtggacagcgtagagtacggacgaggaccaacggtctagtagttagttaccgtgggtcggtaccggggtgggtccgggtggggggaaccggggtanacggggaccgagggtcccggtagggggaccctaaaccggggg

SEQ ID NO: 374534 - DNA, 643 bp, Homo sapiens
  misc_feature: GZ8MTXP02HRGG5.21.19.B08.1.454.CMB.2.raw
  modified_base (597)..(597): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggactcccgcccttcacgtacctatagtatgaagttggactccgccgaggcctaccgaagggaaaggggctagggaggtcggctcgtcacgagtattaggtggtagtagttagttacatatattacgcagtactcgagtgacgacgggtacctattaccaacctatcctaccgagaacgaaccaaaccgaccaaagtaacttccctagtaactctagaacaaagtggaacagtccgtaaggaaggtacgaacggaaggaaccgtacggtacttaacgtaggttaattaccgtgggtcgggtccgggggtgggtccggggtaggggggaaccggggtaanacgggaacggtacgggacggtacggggggacccgtaaacccggggg

SEQ ID NO: 374535 - DNA, 520 bp, Homo sapiens
  misc_feature: GZ8MTXP02G2LU9.21.19.B08.1.454.CMB.2.raw
  modified_base (415)..(415): a, c, t, g, unknown or other
  modified_base (470)..(470): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgcaggctccaggaaaggggctggagtggctctcacagattagtggtagtagtagtttcatatattacgcagactcagtgcagggccattcaccatctccagagacaacgcaaagattcccngtatctgacaaatggacagcctgagagtcgaggacacggcttaagtgtattacgnggtgcgggtggcgtgggggcgggatggacaggcgtcggggaccaacgggg

SEQ ID NO: 374536 - DNA, 572 bp, Homo sapiens
  misc_feature: GZ8MTXP02GB8ZY.21.19.B08.1.454.CMB.2.raw
  modified_base (401)..(401): a, c, t, g, unknown or other
  modified_base (425)..(425): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggatcccgccttcagtacctatagtatgaattggatccgcaggctcgagggaaggctggagtggctctcacagtattaggtggttagtagttagttactatattattacgcagtactcgagtgcgacgggcattccactatcncagagacaacgacaagacttcccngtactcacgacaaacgtgggaccacggtcctaggacgaggtaccgaaggaccgacggtactagtcggttaacttacgtgggtggtcggggtcggtccggtaggggggcggtaagtcggacgacggtcgcgggggccctaaaccgggg

SEQ ID NO: 374537 - DNA, 637 bp, Homo sapiens
  misc_feature: GZ8MTXP02H5T0J.21.19.B08.1.454.CMB.2.raw
  modified_base (259)..(259): a, c, t, g, unknown or other
  modified_base (555)..(555): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctcgnggactcccgccttcagtacctatagtatgaatggactccgccaggcctaccgaagggaagggcgtaggaggtggctcgcagagtattaggtggttagtagttagtttacatattattacgcagtactcgagtgacgagggcctattcccacctatacccgtaccaagaacgaaaccgaaaccgaccgtaaacgtaacctttccctagttaactcgtaacgaactaaaacgtcgggaactacgacccgtagaacgtaggacggagaaccgtaggtacttagtagttaaccgttacgnggtacgggtcgggggtggtccgggggtagggggaacgggtagacggacggacgacggggtcgggggaacccgtaaccggggg

SEQ ID NO: 374538 - DNA, 634 bp, Homo sapiens
  misc_feature: GZ8MTXP02H800Y.21.19.B08.1.454.CMB.2.raw
  modified_base (591)..(591): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggagcctggtcaagccgtggggggtccctgagactctcctgtgcagcctctggactcccgccttcagtacctatagtatgaattggactccgccaggcctccgaagggaaaggggctaggagtggctctcacagattagtggtagtagtagtttacatattattacgacagactcagtgacgagggcctattccaacatcctacaagacgaacaaccgacctaaacgtaacttcccctagtacgttcctaaggactaaaaagttgggaaaccagtaccgtaggaaggtacgtacgggaaacggaccgtaacggtacttaacgttagtttacgttaaaccgttgggtacggtccgggggtaggtcggtcggggggaacggggttanacgggacgtacggtccggtacggggggacccgaaacccggggg

SEQ ID NO: 374539 - DNA, 559 bp, Homo sapiens
  misc_feature: GZ8MTXP02J0U8H.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtggggggtccctgagactctcctgtgcagcctctggactccgccttcagtacctatagtatgaattggatccgcaggctccgaggaaggggctggagtggctctcacagattaggtggtagttagtagttcatatatacgcagactcagtgcgagggccgatcacatctacagagacaaccgacaagtaacttcccagtactctagactaaatgggaacacgcctagagtagtcggaggacgacggtactagtacgtaattacgtggtcggcggggtgggccggtgggggccggggtatcgggaactcgggcgtacgggggaccgtaaccggggg

SEQ ID NO: 374540 - DNA, 536 bp, Homo sapiens
  misc_feature: GZ8MTXP02GVBFL.21.19.B08.1.454.CMB.2.raw
  modified_base (371)..(371): a, c, t, g, unknown or other
  modified_base (493)..(493): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcctggggggtccctgagactctcctgtgcagcctctggatcccgccttcagtacctatagtatgaattggatccgcaggctccgaggaaaggggctggagtggctctcacagattagtggtagtagtagttcatatattacgcagactnagtgcgagggccgtattccaccatctaccagagacaaacgaccaaagaaacttcccctgtaatctagacaaaagtggaaccagccctagagacgtcgaggacacggctaatgtattactggngcgggtggcgtgggggcgggatgacgagcgacggggcaacggg

SEQ ID NO: 374541 - DNA, 532 bp, Homo sapiens
  misc_feature: GZ8MTXP02FTXEH.21.19.B08.1.454.CMB.2.raw
  modified_base (364)..(364): a, c, t, g, unknown or other
  modified_base (422)..(422): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtggggggtccctgagactctcctgtgcagcctctggatccgccttcagtacctatagtatgaattggatccgccaggctccaggaaaggggctggagtggctctcacagatagtggtagtagtagttcatatattacgcngactcagtgcgagggccgattcacatctacagagacaacgcaaagactccctgtatcngacaaagtggaactagcctagacgagtcgagacacggctagtgtattacgtgtcggcgggtcggcggtgggggcggggagtcggacgaggcgtacgggggaccaacgggg

SEQ ID NO: 374542 - DNA, 518 bp, Homo sapiens
  misc_feature: GZ8MTXP02GG0BE.21.19.B08.1.454.CMB.2.raw
  modified_base (355)..(355): a, c, t, g, unknown or other
  modified_base (504)..(504): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatcccgccttcagtacctatagtatgaattggatccgccaggctccgaggaaaggggctggagtggctctcacagattagtggtagtagtagtttnatatattacgcagactcagtgcagggccattcaccatctcagagacaacgccaaagaacttcccagtatctagacaaatggaacagcctgagagtcgaggacacggctatgtattactgtcggcgggtgcgtgggggcgggatggacgngcgcgggacgacgg

SEQ ID NO: 374543 - DNA, 590 bp, Homo sapiens
  misc_feature: GZ8MTXP02HAYQ8.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctgtggactccgccttcagtacctatagtatgattggatccgcaggctccgaagggaaagggctaggagtggctcgtcacagattagtggtatagtattcatatattacgctagactcgagtcgcgacgggccgtattccgaccatcctacgagaacgtaacaaccgaccaaagtaacttcccctggtaactctagacctaaagtcgactacgccttaggaacgtacgtacggaacgaacgacggtactagtacgttaacttcgtggtacggcggggttacgcgggttagggggaacggtagcgtacgacggtcgtacggggtacaacccggggg

SEQ ID NO: 374544 - DNA, 611 bp, Homo sapiens
  misc_feature: GZ8MTXP02I57KQ.21.19.B08.1.454.CMB.2.raw
  modified_base (444)..(444): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggactccgccaggcctccgaaggaaggggctggagtggctctcacagtattggtaggtagtagtagtttcattatacttacgacagtactcgagtgcgtagggccattaccactatctacaagagaaccaaccgacctaaagtacttaccccngtaactctagactaaagtcggaactacgaccttagaggtacgtacggaacgtacgaccggtcttaagttaggtactttacgtggtacgggtcggggttacgggaccggtggggggaaccgggtagtcggaacggcggtcgggtacgggggtaccgtaaacccggggg

SEQ ID NO: 374545 - DNA, 570 bp, Homo sapiens
  misc_feature: GZ8MTXP02JB96J.21.19.B08.1.454.CMB.2.raw
  modified_base (253)..(253): a, c, t, g, unknown or other
  modified_base (403)..(403): a, c, t, g, unknown or other
  modified_base (509)..(509): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcngcctctggatccgccttcagtacctatagtatgaattggatccgccaggctccgaggaaaggggctggagtggctctcacgtgtagttaggtggtagtagttagttcatatattacgcagtactcagtgcgagggccgattccacatccncaagacgaacaacgacaaacgtaacttcccgtagttactcttagaactaaagtcgaacacgccgtaggagtacggtacgaaggacgacggctagtagttattacgnggtcgggcggggtgcggttgggggcgggtatcggacagggcggtcggggaccgtaacgggg

SEQ ID NO: 374546 - DNA, 596 bp, Homo sapiens
  misc_feature: GZ8MTXP02HYF6O.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggactccgcaggctccgaggaaaggggctggagtggctctcacagtatttaggtggtagttagtagtttacattaatattacgcagactcagtgacgagggcctattccaaccatctaccagagaaccaacgaccaaagaactttcccgagtactctagactaaaagtcggaacacgaccgtaggaaggacgtacggaaggaaccgacgggacttagtgttaattacgtggttcggcgggggttcggcggtagggggaacggggtagtacggaccggaggtcggtacgggggaccgtaaaccgggg

SEQ ID NO: 374547 - DNA, 626 bp, Homo sapiens
  misc_feature: GZ8MTXP02G09M9.21.19.B08.1.454.CMB.2.raw
  modified_base (370)..(370): a, c, t, g, unknown or other
  modified_base (376)..(376): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggatccgccaggctccgagggaaggggctggagtggctctcacagtattagtggtagtagtagttctatatattacgcngtactnagtgcgagggccgtattccaacctatcctacaagacgaaccaaccgaccaaagtaacttcccgtagtacttcgtagaactaaaagtcgggaactacggacccttagggacggtacggtacggaagggtaccgacgggtacttaagtcggttaacttacggtggtcggggtcgggggttcggtcggggtcgggggggcgggtaagttacgggaacgtcggggccggtcggggggaacccgtaacccggggg

SEQ ID NO: 374548 - DNA, 563 bp, Homo sapiens
  misc_feature: GZ8MTXP02IYSQK.21.19.B08.1.454.CMB.2.raw
  modified_base (245)..(245): a, c, t, g, unknown or other
  modified_base (423)..(423): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggtttcctagttactattttagaaggtgtccagtgtgaggtgcatctggtggagtctgggggaggcctgggtcaaggcctgggggtccctgagactctcngtgcagcctcgtggatccgcttcagtacctatagtatgaattggatcccgccaggctccgaggaaaggggctggagtggctctcacagatttaggtggtagtagttagtttcaatatattacgcagtactcagtgcaggggcattcacatcacagacacaaccgcaaagtaacttccngtaactctagactaaagtcggacacgcctggaagtagcggagacgacgtctagtagtattacgtggttcgggcgggtcgggtcgggtagggggtcgggacgtacggacggtacggccgggtacgggggaccgtaacgggg

SEQ ID NO: 374549 - DNA, 516 bp, Homo sapiens
  misc_feature: GZ8MTXP02JG3JW.21.19.B08.1.454.CMB.2.raw
  modified_base (339)..(339): a, c, t, g, unknown or other
  modified_base (396)..(396): a, c, t, g, unknown or other
  modified_base (419)..(419): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccgaggaaaggggctggagtggctctcacagattagnggtatagttagtttcatatattacgcagactcagtgcgaggggccattccactatcncagagacaacgcaagaacttccngtatctgacaagtgaccagcctgagagtcgaggacacggctatgtatacgtgtcgcgggtgcggtggggcggatcgacgagcgtcgggcgtaacggg

SEQ ID NO: 374550 - DNA, 550 bp, Homo sapiens
  misc_feature: GZ8MTXP02JGZ2N.21.19.B08.1.454.CMB.2.raw
  modified_base (258)..(258): a, c, t, g, unknown or other
  modified_base (393)..(393): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctntggactccgccttcagtacctatagtatgaattggatccgccaggctccgaaggaaggggctaggagtggctctcacagattagtggtagtagtagttcatatatacgcagactcagtgcgagggcatcacatcncagacgacaacgcaaagtacttccctagtactctgacaaagtcggaaccagcctaggacgtagtacgaggaccacggtactaagtgttaatacgtggtcggccggggtggcggtgggggcggatcggaccgaggcggtacgggggacctaaccgggg

SEQ ID NO: 374551 - DNA, 530 bp, Homo sapiens
  misc_feature: GZ8MTXP02FVHE8.21.19.B08.1.454.CMB.2.raw
  modified_base (368)..(368): a, c, t, g, unknown or other
  modified_base (421)..(421): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggatccgcaggctccgaggaaaggggctggagtggctcgtcacagattagtggtagtagtagtttcatatattacgnagactcagtgcgagggccattcacatctcagagacaacgccaaagacttcccngtatctagacaaatggaacaggcctagagagtacgagacacggctatgtattacgtggtggcgggtgcgtgggggcgggatcggacgaggcgtcggggacctaacgggg

SEQ ID NO: 374552 - DNA, 591 bp, Homo sapiens
  misc_feature: GZ8MTXP02HYNXV.21.19.B08.1.454.CMB.2.raw
  modified_base (380)..(380): a, c, t, g, unknown or other
  modified_base (573)..(573): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggagcctggtcaagccgtggggggtccctgagactctcctgtgcagcctctggactcccgcttcagtacctatagtatgaattggactccgccaggcctaccgagggaaaggggctggagtggctctcacagattaggtggtagtacgtagtttcatattatacgcagtaactnagtgacgacggggcctatccaaccattccaccaagacgtaacccaaacggcccaaaagtaactttccccgagtacttaccgagtaactaaagtcggaaccagcctaaggagaacgtaccggaaggacctacggaccttataggttataacgtggtccggaggggtcgacggtgggggaaggagtacgaacggnggacggtcggaccgacgg

SEQ ID NO: 374553 - DNA, 587 bp, Homo sapiens
  misc_feature: GZ8MTXP02HH4TT.21.19.B08.1.454.CMB.2.raw
  modified_base (374)..(374): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggactccgccaggctccgaagggaaaggggctggagtggctctcgacagtattagtggtagtagtagtttcatatattacgcngactcagtgcgagggccattccaacctatcctccgaagaacgacaaccgaccaaagtaaccttcccgagttactcgtgactaaagtcgggaacagccctaggaaggtagtacggaaggaacgacggtacttaagtagttactacgtggtcggcggggtggccggtgggggaacgggtatcgggacgaggtccggtacggggaccgtaacgggg

SEQ ID NO: 374554 - DNA, 567 bp, Homo sapiens
  misc_feature: GZ8MTXP02INDTB.21.19.B08.1.454.CMB.2.raw
  modified_base (376)..(376): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggactccgccaggctccgaggaaggggctggagtggctctcacagtattagtggtagtagttagtttcattatattacgcagactnagtgcgagggcctattccgaccattccaccgagaacgaacaaccgacaaagtaacttcccagtactcgtagactaaagtggacacgcctaggaagtgtacgaggaccgaggtactagttgtattacgtggtcggcgggtcggcggtagggggcggtagtcgacgaggtccggtcggggaccgtaaccgggg

SEQ ID NO: 374555 - DNA, 667 bp, Homo sapiens
  misc_feature: GZ8MTXP02HLPUD.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatctggtggagtcgtggggagcctggtcaagccgtgggggtccctgagactctcctgtcgcagcctcgtggactcccgtccttcacgtacctatagtatgaattggactccgccgaggctaccggagggaaaggctaggagtggctctacacagtagttagtggtagtagttagtttacatattattacgctagtactcgagtcgacgaggggacctattaccacctattcccacaagacaacaaccgaccaaagtaccttcctagtactacgtagaaccgtaaagtcggaacgtacgtaccgaggaggtacggtacggaaggaccgtaccgggtacttaacgtaggttaactttaaccggtagggttacgggggccgggggttacggggtccggggttagggggggaaccggttacggtaggtaaccccggaagggttccccgggggtacgggggtacccggtaaaaccccggggg

SEQ ID NO: 374556 - DNA, 547 bp, Homo sapiens
  misc_feature: GZ8MTXP02JCUF2.21.19.B08.1.454.CMB.2.raw
  modified_base (353)..(353): a, c, t, g, unknown or other
  modified_base (366)..(366): a, c, t, g, unknown or other
  modified_base (466)..(466): a, c, t, g, unknown or other
  modified_base (518)..(518): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgcaggctccgagggaaagggctggagtggctctcacagattagtggtatagtagttnattatattacgcngactcagtgcaggggccattccactatccgtcagagtacaaccgcaaagacttcccagtatctgactaaagtcggactagcctagagtaggacgaggacncggtactaagttgtaaattcgtggtacggtcggggtggcggtgggggcggtntaggacgagcggtcggggacctaacgggg

SEQ ID NO: 374557 - DNA, 566 bp, Homo sapiens
  misc_feature: GZ8MTXP02I25IL.21.19.B08.1.454.CMB.2.raw
  modified_base (499)..(499): a, c, t, g, unknown or other
  modified_base (515)..(515): a, c, t, g, unknown or other
  modified_base (549)..(549): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctcgtggactccgccttcagtacctatagtatgaattggatccgccaggcctccgaggaagggctggagtggctctcacagtattagtggtagtagtagttcatatattacgcagactcagtcgcgacgggccgtattccaacctatcctaccgaagaacgaaccaaccggacctaaagtaaccttcccagttaactcctagaactaaagtcggaacacgcctagagagtacgaggtacacggntagtagtatacgtggnggtcgggtggcggtgggggcggatcggaaccggnggcggacgggacgacgg

SEQ ID NO: 374558 - DNA, 566 bp, Homo sapiens
  misc_feature: GZ8MTXP02GULG8.21.19.B08.1.454.CMB.2.raw
  modified_base (366)..(366): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcctggggggtccctgagactctcctgtgcagcctctggatccgccttcagtacctatagtatgaattggatccgccaggctccgaggaaggggctggagtggctctcacgagattagtggtagtagtagttcatatattacgcngctcagtgcgagggccgattccaccatcctaccagacgaaccaaccgaccaaagtaacttcccagttaactctagactaaagtcgggaacagccgtagaggagtacgaggactacggctagtagttactacgtggtacggtcggggtcgcggtagggggcgggtagtcggacgtacggcgtcgggggcccgtaaacgggg

SEQ ID NO: 374559 - DNA, 540 bp, Homo sapiens
  misc_feature: GZ8MTXP02JLUOX.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggtttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgccaggctccaggaaaggggctggagtggctctcacagattagtggtatagtagtttcatatattacgcagactcagtgcaggggccattcaccatctacagagacaaccgcaaagaacttccctgtactctagacaaagtcggacagcctagagagtcgagacgacggctagtgtaattactggtcggcggggttcggcggtgggggcgggtagtcggacgaggccgtcggggacctaacgggg

SEQ ID NO: 374560 - DNA, 701 bp, Homo sapiens
  misc_feature: GZ8MTXP02H6X6H.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtgggggtccctgagactctcctgtgcagcctctggatccgccttcagtacctatagtatgaattggactccgccaggctccgaaggaagggctggagtggctctcacagattagtggtagtagtagtttcatatattacgcagactcagtgacgacggggacctattacccaacctagttaccctacccgaaaggaaccgaaacccgaaaccggacccctaaaaacggtaaacccttttcccccgtaaggttaacttaccgtttacggaaaccctaaaaagttcggggaaactaccggtacccgttaaggaaccggtaaggtaccggaaaccggggaactaaccggggtctttaaacgtagtttaaaacgtttccggtaggttaccgggggtcggggttcggggtaccgggtggggggaaccgggggtagtacgggaaccgtagggtaccgggtcgggggaacccgaaacccggggg

SEQ ID NO: 374561 - DNA, 648 bp, Homo sapiens
  misc_feature: GZ8MTXP02HAXBC.21.19.B08.1.454.CMB.2.raw
  modified_base (353)..(353): a, c, t, g, unknown or other
  modified_base (380)..(380): a, c, t, g, unknown or other
  modified_base (385)..(385): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaaggccgtggggggtccctgagactctcctgtgcagcctgtggactcccgccttcagtacctatagtatagaattggatccgcaggctaccgagggaaaggggctaggagtggccttcgtacacagtattaggnggttagtagttagtttcatatatacgnagctnagtgacgagggcctattccactactcaccagacgacaaccgccaaagtaacttccctagtatcctagacctaaagtcggaacacgccgtagaacggtacgacggaggaaccctacgggtacctttaaaggtacggttttaaacctttacggttggggttacggggtccgggggtaggggtcccggggttaagggggggccggggtaaagttcgggacccggagggttcccggggtaacgggggaccccggtaaaacccggggg

SEQ ID NO: 374562 - DNA, 561 bp, Homo sapiens
  misc_feature: GZ8MTXP02H9VFM.21.19.B08.1.454.CMB.2.raw
  modified_base (254)..(254): a, c, t, g, unknown or other
  modified_base (326)..(326): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggagcctggtcaagcctgggggtccctgagactctcctgtgcagcctntggatccgccttcagtacctatagtatgaattggatccgcaggctccgaggaagggctggagtggctctcanagtattagtggtagtagtagttcatatattacgctagactcagtgacgagggcattccacatcctaccagacgaacaacgaccaaagaacttcccagttaatccgtagactaaatggacacgtcctagacgaggtacgaaggacgacgggcttaatcgtaactttacgcggtacggtcggggtcggcggtagggggaacgggtagtcggacgacggtcggtacgggaccggacgg

SEQ ID NO: 374563 - DNA, 587 bp, Homo sapiens
  misc_feature: GZ8MTXP02H64M1.21.19.B08.1.454.CMB.2.raw
  modified_base (406)..(406): a, c, t, g, unknown or other
  modified_base (440)..(440): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggactcccgccttcagtacctatagtatgaattggactccgccgaggctccgaagggaaaggggctggagtggctctcacagattagtggtagtagtagtttcatatattacgcagactcagtgcgaggcctatccacatccacaganaacaacgacaaagtaacttccctagtactcgtanacaaagtcggacagcctaggacgtacgcggaaacgacgacggtattagtgttaacgtacgtggtcgggtccggggtggggtccggtggggggaacgggtagtacggggacgtacggggccggtacgggggaaccccgtaaccggggg

SEQ ID NO: 374564 - DNA, 565 bp, Homo sapiens
  misc_feature: GZ8MTXP02G47AR.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctcgtggatccgccttcagtacctatagtatgaattggatccgccaggctccgaggaaggggctggagtggctctcacagattaggtggtagtagttagtttcattatattacgcagactcagtgcgagggccattaccactatcctacgagacgacaaccgaccaaagtaacttccctagtactctagacaaagtcggacagccgtagacgagtcgaggacgacggtctagtgtactacgtggtacggtcggggtggccggtgggggcggggtatacggacggaggacggtcgggggaccgtaacgggg

SEQ ID NO: 374565 - DNA, 545 bp, Homo sapiens
  misc_feature: GZ8MTXP02I8Q53.21.19.B08.1.454.CMB.2.raw
  modified_base (460)..(460): a, c, t, g, unknown or other
  modified_base (531)..(531): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtgggggtccctgagactctcctgtgcagcctctggatccgccttcagtacctatagtatgaattggatccgaccaggctccgaaggaaaggggctaggagtggctctcacagattagtggtagtagtagtttcatatattacgcagacttcagtgcgtagggcattcacatctcagacgaacaaccgcaaagaacttaccctgtaactctagacaaatcgggaacagaccttgganaggtcgaaggacacggactagtagttattaccgtgtaggccgggtggccgtgggggaacggagtggaacgngcggcggacgacgg

SEQ ID NO: 374566 - DNA, 569 bp, Homo sapiens
  misc_feature: GZ8MTXP02G4KFB.21.19.B08.1.454.CMB.2.raw
  modified_base (368)..(368): a, c, t, g, unknown or other
  modified_base (519)..(519): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggatccgccaggctccgaggaaagggctggagtggctctcacagattaggtggtagtagttagttcatatattacgnagactcagtgcgagggcattccacatctcgagacgacaaccgacaaagacttcccgtagtaactctagactaaagtggacacgccgtaggagtagcggaacgacgacggcttaagtcgttaattacgtgggtacggcgggggtggttcggnggggggtcggtagtggaaccgtggccggtacggggacccgtaaaccgggg

SEQ ID NO: 374567 - DNA, 644 bp, Homo sapiens
  misc_feature: GZ8MTXP02F9GGQ.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctcaggaaaggggctggagtggctctcacagattagtggtagtagtagtttcatatattacgcagactcagtcgcagggccgattccaccatcctacccaagaacgaaccaaacccggaccaaacgtaaactttcccccgtagttaacttcttacgactaaaagtcgggaacaaacgcccgttaggaggtaacggttaccggaagggaaccacggggtactacgttagttaatttaaccgtaggttcgggaccgggggttagggcccgggttacgggggggggaacgggggtacgggtacgggtacggacggtaccgggtaccgggggtaccgggtaaccgggg

SEQ ID NO: 374568 - DNA, 571 bp, Homo sapiens
  misc_feature: GZ8MTXP02JPWQ0.21.19.B08.1.454.CMB.2.raw
  modified_base (336)..(336): a, c, t, g, unknown or other
  modified_base (420)..(420): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatagaatggatccgcaggctccgaggaagggctggagtggctctcacagattagnggtagtagtagttcatatattacgcagtactcagtgcgagggcattcaccatcctacagacgacacgacaaacgaacttccccngttaactctacgactaaagtacgggacaacgtcctaggaaggtacgtacggaggaacgacgggacttatagtagttacgtggtcggtcgggggtggtccggtggggggcgggtagtacggacgtaggccggacgggggcccgaaacggggg

SEQ ID NO: 374569 - DNA, 663 bp, Homo sapiens
  misc_feature: GZ8MTXP02I80DZ.21.19.B08.1.454.CMB.2.raw
  modified_base (369)..(369): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggtttcctagttactattttagaaggtgtccagtgtgaggtgcatctggtggagtcgtgggggaggcctggtcaaggccgtgggggatccctgagactctcctgtgcagcctctggatccgccttcagtacctatagtatgaattggactccgccaggctccgaagggaagggcgtggagtggctctcacgagtatagtgtagtagttagttacatatattacncagactcgagtgacgacgggccgtattcccactactctaccgaagacacaaaccgaccaagtaacttccctagtactcgtacgaactaaagtacgggaactacggaccgtaggtaaggaaccggtcggaaacgggaaccgtaaccgggtcgtttaaacgtttagggttaaaactttaccgggtagggttacggggtccggggggtttaacgggcccgggggtttaaggggggacccgggggtaagtaccggggtaaacggccgggtacggggtaccggggggaaacccccgggg

SEQ ID NO: 374570 - DNA, 621 bp, Homo sapiens
  misc_feature: GZ8MTXP02H232Q.21.19.B08.1.454.CMB.2.raw
  modified_base (256)..(256): a, c, t, g, unknown or other
  modified_base (343)..(343): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggagcctggtcaagccgtggggggtccctgagactctcctgtgcagcctntggatcccgccttcagtacctatagtatgaattggatccgcaggctccgaggaaaggggctggagtggctcgtcacgagatttaggnggttagtagtagtttcataatattacgcagactcagtgacgaggggcctattccaacatcctaccaggacaacaacgccaaaagaacttcccgagtaatctagactaaagtcggaacacgccctaggaacgacgtacgggaacgacgaacgggtccttaagttacggttaatttaccggtggttacgggtaccgggggttggcccgggttacgggggggaaggggttacctagggtaccgggtaggcccggttcggggggaacccctaaaccgggggg

SEQ ID NO: 374571 - DNA, 646 bp, Homo sapiens
  misc_feature: GZ8MTXP02FZE72.21.19.B08.1.454.CMB.2.raw
  modified_base (612)..(612): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctgggtcaaggccgtggggggtccctgacgactctcctgtgcagcctcgtggactcccgcttcagtacctatagtatagaattggactcccgcaggcctaccgaagggaacgggctgggagtggctctcacgtagtagttaggtggtagtaccgttagtttacaattattacttacgactagactcgagtcgacgacggggcctattccacctatccctaccgaagaagaaccaacgaaccgaaagttaaccttacccgtagttaaacttccgtagtaaacccgtaaaagttcgggaacttaaacggcccgttaggaacggtacgtaggacggacgtacgctttaagtacgttaattaccggtggtaccggaggggtcggcggggttggggaacggttnacggtacggaggtcccggtagggaccgaccgggg

SEQ ID NO: 374572 - DNA, 554 bp, Homo sapiens
  misc_feature: GZ8MTXP02GYQJV.21.19.B08.1.454.CMB.2.raw
  modified_base (512)..(512): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggatccgcaggctccgaggaaaggggctggagtggctctcacagtattaggtggtagtagtagttcattatattacgcagactcagtgcgagggccattcacatctccagaagacaacgaccaaagtaacttcccctagtactctagactaaaagtggaactagccctaggaaggacgtacgaggaccgacgctaagtgttattacgtggtcgtacggggnggcgtgggggcggataggactaggcgtacggggctaacgggg

SEQ ID NO: 374573 - DNA, 662 bp, Homo sapiens
  misc_feature: GZ8MTXP02IBQT6.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctccgtgtgcacgcctcgtggactcccgtccttcacgtacctatagtatagaattggactccgccaggcctaccgaggaaacgggctaggagtcggctcgtcaacgagtaattaggtaggtagtagttagtttacattataacttacgcacgtactacgagtcgacgacggggacctacgttaccaacctacttaccgtacccgaaaggaaccgaaaccgaaaccggaccctaaaaggtaaccttcccgtaaggttaccttaccgttagaacctaaaaggtcggaacacgccgtagaacgtacgtacggaagaccgaacggacttaagtcgttaatacgtgggtacgggccgggtggtaccgggtgggggaacgggtacgaggtaccggaggtccgggtacggggacggtaacccggggg

SEQ ID NO: 374574 - DNA, 579 bp, Homo sapiens
  misc_feature: GZ8MTXP02IFHFR.21.19.B08.1.454.CMB.2.raw
  modified_base (332)..(332): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatctggtggagtcgtgggggagcctggtcaagccgtgggggatccctgagactctcctgtgcagccctctggatcccgtccttcagtacctatagtatgaattggatcccgcagctcgaggaagggctggagtggctctcanagattagtggtagtagtagtttcatattattacgcagactcgagtcgcgagggcccgtaattcactaaactctaaccagaacgaaccaaacgaccaaaagtacttacccctagttatcctagtaacaaagtacggaacagacctaggagacgtacggagacgacgtacgttattagtattacgtggtcgggtcggggtcggcggggtcgggggacggggtgtacggacgaggtcggacggggaccgg

SEQ ID NO: 374575 - DNA, 593 bp, Homo sapiens
  misc_feature: GZ8MTXP02G9BPS.21.19.B08.1.454.CMB.2.raw
  modified_base (337)..(337): a, c, t, g, unknown or other
  modified_base (349)..(349): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggactccgccaggcctccgaagggaaaggggctaggagtcggctcctnacagtattaggnggtagtagttagtttcatatattacgcagactgagtgacgagggccattccaccgatctaccagacgacaaccgacaaacgtacttccctagtactctacggaactaaagtcgaccaagtccctagacgtaggtcgaaggaccgtacggacttagtacgttagttaaccgtgggtacgtccgggggtagtccgggtacgggggaacgggtacgacggacgtaggcggtaacgggcccgaacggg

SEQ ID NO: 374576 - DNA, 705 bp, Homo sapiens
  misc_feature: GZ8MTXP02HR58H.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggaggcctggtcaagccgtgggggtccctgagactctcctgtgcagcctcgtggactcccgccttacacgtacctatagtatagaattggactccgcgaggcctaccgaagggaacgggcgtaggaggtcggcctctacgaacgtagtaagtttaggtggttaagttaagttaagtttacaagttaattaacttaccgactacggtactacgtagtacgaccgacggggtaccctattacccacctagtccctcgaaacgacgaaccaaccgtaaccaaagttaccttccccgttagtacttcgtagaaacgtaaacgtacggaacgacgaccctaggaagtacgggtaccggaggaaccgtacgggtaacttagttacggttaccgttaaggtcggggtaaacggggttcgggggtccgggtcggggtaggggggtaaccgggtagtaacggacggtaacggtcccggggaacgggggtaaccccggtaacccggggg

SEQ ID NO: 374577 - DNA, 584 bp, Homo sapiens
  misc_feature: GZ8MTXP02JK19D.21.19.B08.1.454.CMB.2.raw
  modified_base (387)..(387): a, c, t, g, unknown or other
  modified_base (400)..(400): a, c, t, g, unknown or other
  modified_base (459)..(459): a, c, t, g, unknown or other
  modified_base (499)..(499): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgagtgcatctggtggagtcgtgggggaggcctggtcaagccgtggggggtccctgagactctcatgtgcagcctctggactcccgccttcagtacctatagtatgtaattggactcccgccgaggcctaccggaaggggaaaggggctagggtagtcggctctcacagtattaggtggtagtagttagtttacattatattacgnaacgtactcgagngacgagggcctattccactatcacagacaccacgacaagtacttcccgtatactcgtanactaaagtcgaactacgccaggtagacgtaggaacggaancgggtactagttagtaacttggtcgtggggccgggtggtcggtgggggaggttacacggacgtacggcgggtcggggaaccccgg

SEQ ID NO: 374578 - DNA, 577 bp, Homo sapiens
  misc_feature: GZ8MTXP02GVNRM.21.19.B08.1.454.CMB.2.raw
  modified_base (534)..(534): a, c, t, g, unknown or other
  modified_base (557)..(557): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggatccgccttcacgtacctatagtatgaattggactccgccaggctaccgaggaaaggggctggagtggctctacacgagtagttagtggtagtacgtagtttcatatattacgcagactcagtgcgagggaccgtattacgacctatcctaccgaagaacgaaccaaccgaccaaaagtaaccttcccgtagtactctagactaaaagtcgggaacacgccgtagacgtagacggaggaccacggctatgttattacgtggtcggcggggtcgngggtgggggcggtagtgaccggnggcggtacggggacgtacgg

SEQ ID NO: 374579 - DNA, 631 bp, Homo sapiens
  misc_feature: GZ8MTXP02HE945.21.19.B08.1.454.CMB.2.raw
  modified_base (258)..(258): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctntggatccgccttcagtacctatagtatagaagttggactccgccgacggtcctaccggaaggggaaacggggtcgtaggggaggtcgggcctccgtacaacgagtaagtttaggtagggttaagtacggtttagtttcaattaattacttacgacagtactcagtgacgacgggccgtacttacccaacctactcaccgaagaacgaaccaaccgactaaagtaacttccctagtatctagactaaagtcgactagcctaggagacgtggaacgacacggtactagtagttactaggtcggcggtcggggtacggtggtcggggggaaggttacgacggaggacggtcggacgggggacccgtaaaccggggg

SEQ ID NO: 374580 - DNA, 592 bp, Homo sapiens
  misc_feature: GZ8MTXP02HWF2M.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctgggtcaagccgtggggggtccctgagactctcctgtgcagcctctggactccgccttcagtacctatagtatgaattggatccgcaggctcgaggaaagggctggagtggctctcacagattaggtggtagtagtagttcatatattacgcagtactacagtcgacgacggggcctattccaccatcctacgaagaacgaaccaaacgaccaaagtacttccctagtactctagactaaaagtcggaacacgacccgtgaaggtacggtacggaacggaccgacggtactagtagttaattacgtggtacggcggggtcggcgggtagggggaacggggagtacggacgaggtcggtacgggggcccgtaaccgggg

SEQ ID NO: 374581 - DNA, 658 bp, Homo sapiens
  misc_feature: GZ8MTXP02HOFJQ.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggagcctggtcaagccgtggggggtccctgagactctcctgtgcagcctgtggactcccgccttcagtacctatagtatgaattggactccgccagctccgaggaaaggggctggagtcggctctcacagtattagtggtagtagtagtttcatatattacgcagtactcagtcgacgacgggccgtacttaccacctatcctaccgagaaacgaacaaaccggaccaaaagtaacttcccctagtaaacttcgtaaggacctaaaagtcgggaacacgtacccgtagaacggacggtccggaaaggtacccgaacgggtaccttaagttaggttaaactttaccggttgggtcgggtcgggggttacggggaccggggttcggggggaacgggggtaaagtacggggaacggtacggggtccggggtacgggggaacccggtaaccggggg

SEQ ID NO: 374582 - DNA, 575 bp, Homo sapiens
  misc_feature: GZ8MTXP02I1TR3.21.19.B08.1.454.CMB.2.raw
  modified_base (251)..(251): a, c, t, g, unknown or other
  modified_base (376)..(376): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggaggcctggtcaagccgtgggggtccctgagactctcctgtgcngcctctggactcccgtccttcagtacctatagtatgaatggactccgccaggcctccgaaggaaggggctggagtggctctcacagtattagtggtagtagtagttacatatattacgcagactnagtgcgaggccatcacctatcacgagagacacgacaaagtaacttccctagtacgtctgaactaagtcggaactagaccgtgaagagtcggaaggaccgacggtcttaagtcgttaattcgtaggtcgggcggggttgggccggttggggggccgggaatcggaaccggaggtccggtacgggggaccgtaacccgggg

SEQ ID NO: 374583 - DNA, 545 bp, Homo sapiens
  misc_feature: GZ8MTXP02IV9I4.21.19.B08.1.454.CMB.2.raw
  modified_base (401)..(401): a, c, t, g, unknown or other
  modified_base (419)..(419): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctgggggtccctgagactctcctgtgcagcctctggatccgccttcagtacctatagtatgaattggatccgccaggctccgaggaaaggggctggagtggctcgtcacagattagtggtagtagtagtttcattatattacgcagctcagtgcaggggccattcaccatctaccaganacacgcaagaacttcccngtactctagacaaatcggaacagccctgagtacgtacgaggacacgggtctatgtacttacgtggtcggcgggtcggcgtagggggcgggtatcggaacgtggcggtcggggacccgtaaacgggg

SEQ ID NO: 374584 - DNA, 638 bp, Homo sapiens
  misc_feature: GZ8MTXP02IGRWG.21.19.B08.1.454.CMB.2.raw
  modified_base (371)..(371): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcagccgtgggggtccctgagactctctgtgcacgcctcgtggactccgccttacacgtacctatagtatagtaattggactccgccgaggcctaccggaagggaagggcgtaggagtcggctcctacacagtagtagtggtagttagttagttnagtatattacgcagtactagagtcgacgtacggggactactaccgactactaccctaccgaagaacgaaaccgaacccgaaccgtaaacgtaaacccttaccgttagtactacctacgaaccgtaaagtacggacacgtaccgtaggacgaggtacgaggaccgacgtctacgttagttacgtacgtcggtaggtcggggtacggtcggtagggggtaacggacgtaggacggacggtacggggtaccggggaaccggaacccgggg

SEQ ID NO: 374585 - DNA, 636 bp, Homo sapiens
  misc_feature: GZ8MTXP02JZPE6.21.19.B08.1.454.CMB.2.raw
  modified_base (397)..(397): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggactccgccaggctccgaaggaaggggctggagtggctctcacagtattagtggtagtagtagtttcatatatacgcagactcagtgcgacgggccattcacctntcctaccagacgacaacgaccaaagtacttccctagtactctagacaaagtcggaacacgtcctaggaaggtacggtacggaacgggtaccaaccggggtacttaacgttacggttaactttaaccggttggggttacgggtccggggggttacgggcccgggggttagggggggaaccgggggtacgtacggggaaccggacgggtccgggtacggggggacccgtaaacccgggggg

SEQ ID NO: 374586 - DNA, 577 bp, Homo sapiens
  misc_feature: GZ8MTXP02GL5GR.21.19.B08.1.454.CMB.2.raw
  modified_base (329)..(329): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggaggcctggtcaagccgtggggggtccctgagactctcctgtgcagcctctggactcccgcttcagtacctatagtatgaattggactccgccaggctacgaggaagggctggagtggctcncacagtagttaggtggtagtagttagttacatatattacgcagactcgagtgacgacggggacctattacccgaacctactcctaccgaagaacgaaccaaccggaccaaagtaccttccctagtactctagactaaagtcggacagccgtagagtacgtacgagacacggactagtgttattacgtggtcggcgggtggacgggtgggggcgggatcggacgaggcggtcggggaccgtaaccgggg

SEQ ID NO: 374587 - DNA, 614 bp, Homo sapiens
  misc_feature: GZ8MTXP02HPCLI.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctgtggactccgccttcagtacctatagtatgaatggactccgccgaggcctaccgaagggaaacggggctagggagtcggctcgtacacagtatttaggtggttaagtagttagtttcattatattacgctagtactcgagtcgacgacggggtacctacttaccaaccacttcccaccaaggacaaaaccgaaccgacctaaagtaacctttcccgattaactcgtagaacaaagtcggacagcctagagagtacgagacgacgtactagtacgttattacgcgggtacggcgggggttcgcggggtcgggggaacggggtacaggacgaggtccggtacggggaccgtaacccgggg

SEQ ID NO: 374588 - DNA, 668 bp, Homo sapiens
  misc_feature: GZ8MTXP02G70QY.21.19.B08.1.454.CMB.2.raw
  modified_base (569)..(569): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatctggtggagtcgtgggggaggcctggtcaagccgtgggggtccctgagctctctgtgcagcctcgtggactcccgtccttcacgtacctatagtatagtaattggactccgccgaggcctacggaaaggggaacggggtcgtaggacggtcggtcctccgtacaacgtagtagtttaggtggttaagtagtttagtttactaattaacttacttacgactacgacttcgaggtcgacggacggggtacctactttaccacctattcccacgaaagaacgaaccaaacccgcaaaagttaaccttcctagtactccgttagaaccttaaagcggtaacacgtaccgtaggaaggtaccgtacgggagaaccgtacggnttaacgtacgttaattcggtgggtacgggtccgggggtggtccggggtagggggaacggatacggacgacggtcggggaccggggaaccgtaaccgggg

SEQ ID NO: 374589 - DNA, 659 bp, Homo sapiens
  misc_feature: GZ8MTXP02GTE5L.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactcccgccttcagtacctatagtatgaattggatccgccaggctccgagggaaaggggctaggagtggctctcacagattaggtggtagtagttagtttcattaattattacgctagactcgagtgacgaggggccgtacttccacctatcctaccagaacgaaccaaccgacccaaagtaacttaccccgtagttaactccgttagacctaaaagtcggaacctaacgtcccgtagggtaacggacgggttaccggaacgggaaccgtaccggggtacttaagttacgttaaactttaacgttgggtacgggccgggggttagggcggggttcggggggaacgggtacgtagggaccgtagggtccgggttaccgggggaccggtaaacccggggg

SEQ ID NO: 374590 - DNA, 595 bp, Homo sapiens
  misc_feature: GZ8MTXP02HZY7S.21.19.B08.1.454.CMB.2.raw
  modified_base (270)..(270): a, c, t, g, unknown or other
  modified_base (335)..(335): a, c, t, g, unknown or other
  modified_base (339)..(339): a, c, t, g, unknown or other
  modified_base (409)..(409): a, c, t, g, unknown or other
  modified_base (447)..(447): a, c, t, g, unknown or other
  modified_base (520)..(520): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggagcctggtcaagccgtgggggtccctgagactctcctgtgcagcctctggactcccgccttnacgtacctatagtatagaattggactccgccaggcctaccgaggaaagggctaggagtggctctnaacngtaagttaggaggtatagtagtttcattatattacgctagactcgagtgcgacgggacctactcaaccgntccaccgagacaacacgacaaagacttccgtagtactntacgaataaagtcggaactacgaccttaggacgtaacggacggaacgacgaccggtattatacggtattacgnggtacgggtccggggtggtccgggagggggccgggaagtaggaccgtagggccggttacggggacccgaacgggg

SEQ ID NO: 374591 - DNA, 608 bp, Homo sapiens
  misc_feature: GZ8MTXP02F3UGO.21.19.B08.1.454.CMB.2.raw
  modified_base (257)..(257): a, c, t, g, unknown or other
  modified_base (373)..(373): a, c, t, g, unknown or other
  modified_base (438)..(438): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggaggcctggtcaagccgtggggggtccctgagactctcctgtgcagcctntggactccgccttcagtacctatagtatgaattggatccgcaggcctacgaggaaagggctggagtcggctctacacagtattaggtggtaagtagtagtttcaattatatacganagtactcagtgcgagggcctattcaccatcctaccagagaaccaacgacctaaagaacttacccngtaactcctagactaaaagtcggaaacgacgtacccgtagacggaacgtacggaacggaccgaacggtacgttaagtacgtttaagttaaccgtggtacggcggggttacggccggttagggggaaccgggtagtacggacgacggtcgtacgggggaccaaaccggggg

SEQ ID NO: 374592 - DNA, 571 bp, Homo sapiens
  misc_feature: GZ8MTXP02JAC4S.21.19.B08.1.454.CMB.2.raw
  modified_base (523)..(523): a, c, t, g, unknown or other
  modified_base (536)..(536): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggtttcctagttactatttagaaggtgtccagtgtgaggtgcatctggtggagtcgtgggggaggcctggtcaagccgtgggggtccctgagactctcctgtgcacgcctctggactccgccttcacgtacctatagtatgaattggactccgcagctcgaggaggggctggagtggctcgtcacgagtagtagtggtagtagttagttacatatattacgcgagactcaagtcgcgagggccgtattccacctattcccgacagacgaacgaacgaccaaagtacttccccgtagtaactctaggacctaaagtcggacagcctaggacgtagtacgagaccgtacgacttacgtagtatcgtagcggcgggtcggngtcgggggaaggngtacggtacgcggtcggtcggggtacgaaccgggg

SEQ ID NO: 374593 - DNA, 682 bp, Homo sapiens
  misc_feature: GZ8MTXP02GW1VN.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtggggggtccctgagactctcctgtgcagcctctggatccgccttcagtacctatagtatgaattggactccgaccaggcctaccgaaggggaaaggggcgtagggaggtcgggcctcgtacaacgagtaagtttaggtagggttaagtaagtttagtttactaagttacttaacgtttacgctaggtacctacgaggtcgacggacggggtccgtaacttccgaacctaacgtccctaaccgaaggaacgaaaccgaacccgaacaaacgtaacttccccgtagttactcgtacgaactaaagtcggaaccgagacccgtaggaaggtacggtacggaacggaaccgacgggtacttacgttaggttaactttacgtgggtacgggtcggggtcgggtcgggtggggggaacgggtacgtcggaaccggtaggcggtacggggaccgtaacccgggg

SEQ ID NO: 374594 - DNA, 639 bp, Homo sapiens
  misc_feature: GZ8MTXP02GZIY5.21.19.B08.1.454.CMB.2.raw
  modified_base (563)..(563): a, c, t, g, unknown or other
  modified_base (579)..(579): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaaggccgtggggggtccctgagactctcctgtgcagcctctggatcccgccttcagtacctatagtatgaattggactccgccaggctccgagggaaggggctggagtggactcgtacacgtagaagtttaggtaggtagtacgttagtttacaagttattaagttaccgactagtactacgaagttgacgtaacggggcctaatttacccaacctaattccctaaccgaagaaccgaaaccaaacccggaccaaaaggtaaccctttccccgagtttaaactccgtagaactaaaacggtcgggacaacgtcccgtaggagacggtacggaggaccgacggtntaagtgttaattccgngggtcgcgggggtgtcggtgggggaacggtagtacgagacggtcggacggggacaacggg

SEQ ID NO: 374595 - DNA, 591 bp, Homo sapiens
  misc_feature: GZ8MTXP02GZVBI.21.19.B08.1.454.CMB.2.raw
  modified_base (368)..(368): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggatccgcaggctccgaaggaaggctggagtggctctcacagtattagtggtagtagttagtttcataatattacgntagactcgaagtgccgagggcctatccacatactaccaagacgaaccaacgaaccgaaagtaaaccttccctagttactcgttagactaaaacgtgggacacggacccttagaacggtaggtacgacggacgacggtacttagtacgttattacgtgacgggtggggacggtcggtggggaacgggatcggacggtagtccggacgggggacgtaaaccgggg

SEQ ID NO: 374596 - DNA, 771 bp, Homo sapiens
  misc_feature: GZ8MTXP02HWCX8.21.19.B08.1.454.CMB.2.raw
  modified_base (369)..(369): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagccgtggggggtccctgagactctcctgtgcagcctctggatccgccttcagtacctatagtatgaattggatccgccaggctccgaggaaaggggctggagtcggctctcacagtattagtggtagtagtagtttcatatattacgcngtactcagtcgacgacggggacctacgttccaaccacttacccgtacccgaaggtaaccgaaaccgtaaaacccggaccgtaaaaaggtaaccttttacccccgtagttaacttccgttacgaacccgtaaaaagttaggggaacccgtagtccccgttaaggaacgggtaacgttacccggggaaaagggaaccgtaaacccgggggtaaaccgttacggtttaaacggtttaaacgttttaaacccgtttacgggggttagggtcccgggggggggtttacgggggtccccggggttagggggggggggtcccggggggtaaaggtttcggggtaaaaacccggacgggggttccggtttaaccgggggggggacccccggttaaaaacccccggggggg

SEQ ID NO: 374597 - DNA, 667 bp, Homo sapiens
  misc_feature: GZ8MTXP02HK53O.21.19.B08.1.454.CMB.2.raw
  modified_base (408)..(408): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctctgtgcacgcctcgtggactcccgccttcacgtacctatagtatagtaagttggactccgaccgacggcctaccggaaggggaaacggggcgtaggggaggtcgggccttctacacgagtagtttaggtagggttagtacgttagtttcattatattaccganagtactcgagtcgacggacgggacctatccactactcaccagaacacaaccgacaaacgtaacttcccgtatactcgtagaactaaagtcgacacgtaccaggaagtacggacgggaacggaccgtacgggtacttaagttacgggtttaacttaccgggtggtaacgggggcgggggttacgggccgggggttggggggaaccggtagtaccggggacggacgggccggggttacgggggacccggtaaacccggggg

SEQ ID NO: 374598 - DNA, 563 bp, Homo sapiens
  misc_feature: GZ8MTXP02I9ANT.21.19.B08.1.454.CMB.2.raw
  modified_base (362)..(362): a, c, t, g, unknown or other
  modified_base (503)..(503): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctcctgtgcagcctctggatccgccttcagtacctatagtatgaattggatccgccaggctccgaggaaggggctggagtggctctcacagatagtggtagtagtagtttcatatatacgnagactcagtgcagggcattcaccatcctccagacgaacaacgaccaaagtaacttaccccgtgttaactcttggactaaaagttcggaacagaccctaggacgtagtacggaacggactaacgggctaagtgtatttacgngttacggcggggtggcggtgggggcgggggatcggactaggcgtcgggggccgaacgggg

SEQ ID NO: 374599 - DNA, 609 bp, Homo sapiens
  misc_feature: GZ8MTXP02FFS9V.21.19.B08.1.454.CMB.2.raw
  modified_base (328)..(328): a, c, t, g, unknown or other
  modified_base (364)..(365): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggaggcctggtcaagcctggggggtccctgagactctctgtgcagcctcgtggactcccgccttcacgtacctatagtatgattggactccgcaggctcgaggaaagggctggagtggctcncacagtatagtggtagtagtagttcatatattacgnngactacgagtgcaggggacccgtattaccaaccattccaccaaggaacgaaccgaaaccgaccaaaacgtaacttccccgtagttaactcctagaactaaaagtggaaccagacccgtaggaacggtacgacggaacgaaccgacgggacttacgttagttaatttaacgtcggtaggggtcggggtgggtacggtcgggggaacgggagacgacgagtccggacgggggaccgtaaaccgggg

SEQ ID NO: 374600 - DNA, 640 bp, Homo sapiens
  misc_feature: GZ8MTXP02G9YTU.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctcgtggactccgccttcacgtacctatagtatagtaattggactccgccgacggcctacgaagggaaaggggctggagtggctctacacagtattaggtggttagtagttagtttacagttatagttacgcagtactcagtcgacgaggggccgtattccaaccgtaactccctacgaaggaacgaccgaaacccgaccgaaaagttaccttccctagtacttacctgaaccgtaaagtacggactaacgccgtagacgtagacggtaaggacaccgggtatacgtacgttagttacggtggcgggtcggggtcggcgggttacggggggaaggggtatacgggacggtacggtccggggtacgggggacccgtaaaccggggg

SEQ ID NO: 374601 - DNA, 672 bp, Homo sapiens
  misc_feature: GZ8MTXP02JWA5E.21.19.B08.1.454.CMB.2.raw
  modified_base (262)..(262): a, c, t, g, unknown or other
  modified_base (383)..(383): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatcgtggtggaggtcgtgggggaggcctggtcaaggccgtggggggtccctgagactctcctgtgcagcctntggactcccgcttcagtacctatagtatagtaattggactccgccgaggcctaccgaagggaaaggggctagggaggtcggccgtctacacgagtagttaggtggttagtagttagtttanattatattacggataggtacctacgtagtgaccgacgggcccgtatccactactcctaccgagacgaccaacgaccaaacgtactttacccagttactactacggaactaaaagtcggaaacctaggacccgtaggaaacggtacggtaccggaaggtaacccgtacgggtaccgttaaaggtttagtaactttaacgtgggtacggggtccggggttaaggccggggttaggggggaacgggtaagcgggaaccggtagggtaccggggaccggggacgtaacccggg

SEQ ID NO: 374602 - DNA, 682 bp, Homo sapiens
  misc_feature: GZ8MTXP02I5GA1.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggactccgccttcagtacctatagtatgaattggatccgaccaggcctccgaaggaaacggggctggagtggctctcacagtattagtggtacgttagtagtttcatattattacgcagctacgagtcgacgtaggggaccgtataccgacctatcctaccagaacgacccgaaacgaccaaaaggtaccttaccccgtgttaaactcctaggaacctaaagttacgggacctacgcccgttaggaacgtaacggtccggaagggaaccgtaaccggggtacctttaagtaccggttttaaagtttaaccgttacggggttaccgggttacgggggtcggggttcccgggttaggggggggaacccgggtaaggttacggaaacggtcggtaccggtacggggggaacccttaaaccccgggggg

SEQ ID NO: 374603 - DNA, 523 bp, Homo sapiens
  misc_feature: GZ8MTXP02JRO4Z.21.19.B08.1.454.CMB.2.raw
  modified_base (365)..(365): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctggggaggcctggtcaagcctggggggtccctgagactctcctgtgcagcctctggatccgccttcagtacctatagtatgaattggatccgccaggctccaggaaacggggctggagtggctctcacagattagtggtagtagtagtttcatatattacgcngactcagtgcagggccgattccacatctacagagacaacgcaaagacttccctgtatctgacaaatggacagcctgagagtcgaggacacggctatcgtatacctggcggcggtggcgtgggggcgggtatcggacaggccgtggggccctaacgggg

SEQ ID NO: 374604 - DNA, 611 bp, Homo sapiens
  misc_feature: GZ8MTXP02HEWZC.21.19.B08.1.454.CMB.2.raw
  modified_base (258)..(258): a, c, t, g, unknown or other
  modified_base (546)..(546): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctntggatcccgcttcagtacctatagtatgaattggactccgcaggctaccgaagggaaggctggagtggctcgtcacgagtagtttagtaggttagtagttagtttcaattaattagttaccgactacgtaacttcgaaggtcgacgtacggggccctaattccacctacttccaccgagaacgaaccaacgaccaaagtaaccttcccgtagtactcgtagacctaaagtcgaacgtcgaccgtgaacgtaggtacgaggactacggattagtacgttatttaacggnggttcgggcgggtcggtcgggacgggggtaacgtacgtacggacgcggtcggacgggaccgacgg

SEQ ID NO: 374605 - DNA, 630 bp, Homo sapiens
  misc_feature: GZ8MTXP02JZJ82.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggagcctggtcaagccgtgggggtccctgagactctcctgtgcagcctcgtggactcccgtccttcagtacctatagtatagaattggactccgccgaggcctaccggaagggaaacggggctgggagtggacctctacacagtattaggtggtaagtagttagttacattatactacgacagactcgagtgacgacggggcctacttaccgacctaactcctaccgaagaaccgaaccgaaaccgaccgaaacgtaaccttcccgtagtaaacttccgtagaaccgtaaagtacgggaacacgccgtaggaagtacgacggaacgtacgaccggtatagttagtacttacggtggtcggacggggtggacgggtgggggaacgtagtacggacggtacggcggtaccggggacgaaaccgggg

SEQ ID NO: 374606 - DNA, 694 bp, Homo sapiens
  misc_feature: GZ8MTXP02IJP2I.21.19.B08.1.454.CMB.2.raw
  modified_base (366)..(366): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggtttcctagttactattttagaaggtgtccagtgtgaggtgcatcgtggtggagtcgtgggggacgccgtggtacaagccggtcggggggtccctgacgtactctccgtgtgcagtcctgtggactcccgtccttcacgtacctatagtatagtaattggactcccgcgaggcctaccggaagggaaacggggctaggtacgtcggtctcctaccaagngtaagtttaggtaggtagtaggtttacgttacaattataattacggcacggtactgacgtagcgtaacggggcctattacccacctatcccacgaggaacgacaaccggaccaaaagacctttccctagtacttcaagtactaaagtacgggacaacgtccgtaggaacggtaacgtacccgggaaggaaccgacccggacgtttaaacgttgttaaaaccctttaacgggtcgggttacggggtcggggtacgggtccgggggtagggggaacggggtaagtaccggacggtacggggaccggtacgggggtacccggtaaaccggg

SEQ ID NO: 374607 - DNA, 661 bp, Homo sapiens
  misc_feature: GZ8MTXP02JTUTL.21.19.B08.1.454.CMB.2.raw
  modified_base (369)..(369): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactcccgccttcagtacctatagtatgaattggactccgcaggctccgaggaaggggctggagtggctctcacagtattagtggtagtagtagtttcatatattacgnagtactcagtgcgtacggggccgtacttaccacccgtattcccacccgaagaacgaaccaaaccgtacccgaaaacgtaaccttaccccgttagtaactccgtacgaacctaaagtcggaaccacgccgtaggaagtacggtacggaacggtaaccgtacgggtacctttagtacgttaacgtttaccgtggttacggggtcgggggtcgggtcccgggttagggggggaaccgggtgtaacgggtaacggtcgggacgggggttaccgggggaccgttaaaaccccggggg

SEQ ID NO: 374608 - DNA, 561 bp, Homo sapiens
  misc_feature: GZ8MTXP02I1VO7.21.19.B08.1.454.CMB.2.raw
  modified_base (258)..(258): a, c, t, g, unknown or other
  modified_base (393)..(393): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggtttcctagttactattttagaaggtgtccagtgtgaggtgcatctggtggagtcgtgggggagcctggtcaaggccgtggggggtccctgagactctcctgtgcagcctcnggactccgccttcagtacctatagtatgattggatccgcaggctccgaggaagggctggagtggctctcactagtattaggtggtagtagtagttcatatatacgcagactcagtgcgagggctattcaccatcncagacacaccgacaagtacttaccctagtactctagactaagtcgtacgacgtccgtaggacgtacgtacggaggtaacgacggtactacgttagtattacgtggtacggtcggggtcggcggtgggggcgggtagtacggacgaggtcggacggggacccgtacggg

SEQ ID NO: 374609 - DNA, 598 bp, Homo sapiens
  misc_feature: GZ8MTXP02HK7AB.21.19.B08.1.454.CMB.2.raw
  modified_base (370)..(370): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgtccttcagtacctatagtatgaattggatccgccaggctccgagggaaagggctggagtggctctcacagattagtggtagtagttagttacatattatacgnacgactacagtgacgacgggccgattcaccatcctaccgagaacgaacaaccgacctaaacgaacttaccctgtacttccgtagaactaaacgtaggaacgaacgccgtaggacggacggtcgaacgggacacgggtactagtagtacgttacgtggtacgggtcggggtggtaccgggtgggggaacgggtagtaggacgacgcgggtacgggaccggtaaccgggg

SEQ ID NO: 374610 - DNA, 778 bp, Homo sapiens
  misc_feature: GZ8MTXP02IC42I.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttacttattttagaaggtgtccagtgtgaggtgcatcgtggtggagtcggtgggggagccgtggtcaaggccggtggggggtccctggagtactctccgtgtgcacgcctcgtggactcccgtccttcacgtacctatagtatagtaagtggactccgaccgacggacctaccgggaaggggaaacggggtcgtaggggtacggtcggtccttcgtacaacgtaaggtaagtttagggtaggggttaagttaaggtttagtttactaagttaattacgttacgacgtacgtaacctcgaggtcgacgaacggggtaccctaacgttacccaaccgtacttacccgtacccgaaaggaaccgaaacccgaaacccgaacccgtaaaacgtaacccgtttccccgttagttaactaccgtacgaaaccgtaaacggtacggaacggtaccgtacccggtaggaacggtacgggaccgggaacggaaccggaacggtacgttaagtacgtttacgtacggttgggtacggggtccgggggtcggggtaccggggttaggggggaaccggtagtacggggacggtacggggtccggggtaaccgggggacccggtaacccggggg

SEQ ID NO: 374611 - DNA, 587 bp, Homo sapiens
  misc_feature: GZ8MTXP02HL3GO.21.19.B08.1.454.CMB.2.raw
  modified_base (383)..(383): a, c, t, g, unknown or other
  modified_base (514)..(514): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggaggcctggtcaagccgtggggggtccctgagactctcctgtgcagcctctggactcccgcttcacgtacctatagtatgaattggatccgcaggctccgaggaagggctggagtggctacgtccaagagtagttaggtggtagtagttagttcagtatattacgcagaccttagngtgcgagggccattccacgtattccaccaagacgaaccaacggaccctaaagtaaccttcccgtagtactacgtagacctaaagtcggaactagccgtagagaacggtcggaaggacgacggtactaagtntaagttacgttggaggtccgggtaggcggtaagggggcgaagtggaacgcggtcgacggggacctaaccgggg

SEQ ID NO: 374612 - DNA, 592 bp, Homo sapiens
  misc_feature: GZ8MTXP02JPC2A.21.19.B08.1.454.CMB.2.raw
  modified_base (370)..(370): a, c, t, g, unknown or other
  modified_base (376)..(376): a, c, t, g, unknown or other
  modified_base (498)..(498): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggactccgccaggctccgaggaaggggctggagtggctctacacagtattagtggtagtagttagttcatatattacgnagactnagtgcgacgggctacttcacatcacagacacaacgacaaagtactcctagtactctagacaaagtcggaacacgtcctaggagacgtcgaacggaccgaggacttagttagttacgttacgngggttcgggtcgggggtacgggtcgggttacggggggcggggtaagtacgggacgtacgggtccgggtagggggaccccgttaaaacccggggg

SEQ ID NO: 374613 - DNA, 574 bp, Homo sapiens
  misc_feature: GZ8MTXP02ISTWV.21.19.B08.1.454.CMB.2.raw
  modified_base (271)..(271): a, c, t, g, unknown or other
  modified_base (488)..(488): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatctggtggagtcgtgggggaggcctggtcaagccgtgggggtccctgagactctcctgtgcagcctctggatccgccttnagtacctatagtatgaattggatccgccaggctcgaggaagggctggagtggctctcacagtattagtaggtagtagttagtttcagttattattacgcagtactcaagtgaccgacggggcctattaccactatccaccgagacgaacaccgacaaagtaactcccagtactctagactaaagtcggaacacgcctagagacgtacgaggtaaccnggtactatgttaattcgtggtcggcgggggttcgcggttgggggaacggtagtcggacgtggacggtacggggactaaaccggggg

SEQ ID NO: 374614 - DNA, 649 bp, Homo sapiens
  misc_feature: GZ8MTXP02H4IQE.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctcgtggactcccgtccttcacgtacctaagtagtatagaattggactcccgccgaggcctaccgaagggaaaggggcgtgggagtggctctcacgagtagttaggtaggttagtagttagtttacgataattattacgctagtactacgagtcgacgacgggggtacctacttcccaacctacttccctaccgaagaaccggaaacccaaaccggtaccgaaaagtaaccctttcccgtagtacttcgtacgaacgtaaagtcggaacgtacgacctaggaacgtacggacgaggacgacggtacttagtagttacgttacgtggtcggtccggggtgtcggttcgggggaaggtactacggacgcggtacggtcggggaaccgtacccgggg

SEQ ID NO: 374615 - DNA, 590 bp, Homo sapiens
  misc_feature: GZ8MTXP02JPPVC.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggactccgccaggctccgaggaaggggctaggagtggctctcacagtattaggtggtagtagttagttacatatatacgcagactcgagtgcgacgggccgtattccactacttccaccgagacgacaaccgaccaaagtaacttccctagtaactcgtagaactaaagtggacacgccgtagaacggtagtacggagacgacgtactagtagttactacgtggtcgggtcgggtcggcggttagggggaacggtacgtacgggacggcggtccgggtcgggggaaccgtaaccggggg

SEQ ID NO: 374616 - DNA, 650 bp, Homo sapiens
  misc_feature: GZ8MTXP02HWYOK.21.19.B08.1.454.CMB.2.raw
  modified_base (391)..(391): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatcgtggtggagtcgtgggggaggcctggtcaagccgtggggggtccctgagactctcctgtgcagcctcgtggactcccgtccttcagtacctatagtatagtaattggactccgaccaggcctaccgaagggaaacggggctagggaggtcggctctcacgagtagttaggtggtagtagttagtttcattatattacgntagtactcagtcgacgacgggcctattccacatcctcagacgaacaaccgacaaagactttccagtacttctagactaaaagtcgggaacacgtccgtaggaacggtaggaccggtaaggacccgacgggtacttaagtacggtttaacttaacggttgggtacgggcgggggttacgggtccggggtacggggggtaacgggggtattacggggaaccggtggggtaccggtaccggggggaccggtaaacccggggg

SEQ ID NO: 374617 - DNA, 616 bp, Homo sapiens
  misc_feature: GZ8MTXP02JYRAO.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggactccgccaggcctcgagggaaaggggctggagtggctctcacagattagtggtagtagtagtttcatatattacgcagactacagtgacgacgggccgtacttccactatcctacagaacacaaacgcaaagtactccctagtactctagacaaagtcgacgacgcctagggaacgacgtacgaagggacctacgggtactagttagttaacttaccggtgggtcggggtacggggtcggggtcggggtacgggggggtccgggtaagttacggggaaccggtaggggttccgggacgggggtaccccgtaaacccgggggg

SEQ ID NO: 374618 - DNA, 485 bp, Homo sapiens
  misc_feature: GZ8MTXP02HJ17R.21.19.B08.1.454.CMB.2.raw
  modified_base (469)..(485): a, c, t, g, unknown or other
tcagtcgtcgctcgcacgaccggtgctcgatttagtgagtcagtaagagaaagggtctggagtggattgggagtgtctataatacggggagtcaatatcgtggtgacactccctactacaacccgtcttttaagagtcgagtcactatatcagtgcgctcgtccacgaaccaggtctccctgaggatgagatctgtgacggccgcagacacggccaagtatttctgtgcgagagaccccggagttagcgacgcctggaggcactggtacttcgatgcgtggggccgtggcgccctggtcactgtctcatcagcttccaccgaacgggccccatccggtccttcccccgtggccgccctcgccgtccaggacgcacctcgtcgggggcacgacgcggcccgtgggccgtgccgtggtcaacggactaccttcccgagcgacgctgaggcggcgtggacaggcgacagagnnnnnnnnnnnnnnnnn

SEQ ID NO: 374619 - DNA, 719 bp, Homo sapiens
  misc_feature: GZ8MTXP02GN9LG.21.19.B08.1.454.CMB.2.raw
  modified_base (674)..(674): a, c, t, g, unknown or other
tcagtcgtcgctcgcacgaccggtgctcgatttagtgagtcagtaagggggctgagagaggagccttagccctggattccaaggcctatccacttggtgatcagcactgagcaccgaggattcaccatggaactgggctccgctgggttttcctagttactatttagaaggtgtccagtgtgaggtgcatctggtggagtcgtgggggaggcctggtcaagccgtggggggtccctgagactctcctgtgcagcctctggactcccgccttcagtacctatagtatgtaattggactcccgcgacggcctaccggaagggaaaggggtcgtagggagtacggtctccgtacacgaggtagtttaggtaggttaggtaagttagtttacaattagttactttaaccggactacggtacctgtacggttacggacgtacggggtaccgtacgtttacccaacctacttaccctaaccgaaggaacgaaaccgaaacccgaaccgtaaaacggttaacctttacccccgttaggttaaccttccgttaaacggaaccgttaaaagtaccgggaactaccgggacccgttagggaaggttacgggaccggaagggaactacgggtacttagtacgtttagttacgtgggtcggaccgggggtggtcggggtcgggggnggtacgtagggacgtcgggtcgggacggggtaccggtaaccgggg

SEQ ID NO: 374620 - DNA, 733 bp, Homo sapiens
  misc_feature: GZ8MTXP02IC8SO.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggactcccgccttcagtacctatagtatgtaattggactccgccgaggcctaccgaagggaaacggggctaggagtggctctcacagtattaggtggtagttagttagttacatatattacgcagtactcagtgacgacggggacctagttacccacctagtaccctaccgaagaacgaaccgaaaccggacctaaaagtaacctttccccgtagttaaaccttcgtacggaactaaaaagttcgggaaacctaacggtcccgttaagggaaacggtaacgggttaccgggtaaaaggggtaacccgaaaaccggggtacctttaaaacggtttacggttttaaacgtttaaaccggtttaggggttcggggtaaccggggggttcggggtaaccggggttggggggggaaccgggggtattacggggaaacccggagggtccgggtacggggggtaccccgtaaacccgggggg

SEQ ID NO: 374621 - DNA, 671 bp, Homo sapiens
  misc_feature: GZ8MTXP02JCHHP.21.19.B08.1.454.CMB.2.raw
  modified_base (528)..(528): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgacgactctcctgtgcagcctctggactcccgccttcacgtacctatagtatagaattggactccgccaggctaccgagggaagggctggagtggcctctcaacgtagtagttaggtaggttagttaagtttacgtttacaagtttaacttaagtttaccggatacggacttacgtaggttcgaccggacggggtacccgtaactttaccaaccctaacttcccgtaaccgaaaggacgaaaccaaccggaccctaaaagtaccttacccgtgtaactcgtagactaaagngtaaccacgccgtagagacggtaccggaggacccgtaggtacttaacgtagttacgttacgtggtacggtccggggttaggccggggttagggggaacgggtatacggaccggaggtccggggtacggggaccgtaaccgggg

SEQ ID NO: 374622 - DNA, 699 bp, Homo sapiens
  misc_feature: GZ8MTXP02G8CTR.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctgggggagcctggtcaagccgtggggggtccctgagactctcctgtgcagcctctggatccgccttcagtacctatagtatgaattggactccgcagcctcgaggaagggctggagtggctctcacgagtagttaggtggtattaggttagtttacaagttatattacggcaggtacttcgaggtcgacgtaacgggggcctagtttacccaaccgtacttccctaacccgaaggtaacgaaacccaaacccggaccaaaacggttaaacctttacccccgagtttaaaccttccgtaacggtaactaaaacgtcgggaccacggtcccgtaggaacggttaacgggcggtaacggaaccggtaacgtccgttaaaatcgggtttaacttaaccggttggggtcggaccggggggttacgcggggttacggggggaaccgggggtattaccggaacgggacggtccgggttaccgggggaacccggtaacccggggg

SEQ ID NO: 374623 - DNA, 558 bp, Homo sapiens
  misc_feature: GZ8MTXP02FGI65.21.19.B08.1.454.CMB.2.raw
  modified_base (371)..(371): a, c, t, g, unknown or other
  modified_base (449)..(449): a, c, t, g, unknown or other
  modified_base (451)..(451): a, c, t, g, unknown or other
  modified_base (463)..(463): a, c, t, g, unknown or other
  modified_base (493)..(493): a, c, t, g, unknown or other
  modified_base (502)..(502): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgcttcagtacctatagtatgaattggatccgcaggctcgagggaaaggggctggagtggcctctcacgagtatagtggtagtacgtagtttcattatagttacgntagacctgagttgcaaggggaccctattaccacctatccgtaccagacgaacaacgacaaagtacttccctagtactntnacaaagtgaacngacctggagagtacgaggacacgatacgtntattacggnggtcgggcgggtcggtcgggagggggcggagacggacgtggacggcggacgtacgg

SEQ ID NO: 374624 - DNA, 607 bp, Homo sapiens
  misc_feature: GZ8MTXP02FPNF0.21.19.B08.1.454.CMB.2.raw
  modified_base (366)..(366): a, c, t, g, unknown or other
  modified_base (372)..(372): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggagcctggtcaagccgtgggggtccctgagactctcctgtgcagcctctggactccgccttcagtacctatagtatgaattggatccgcaggctaccgagggaagggctggagtggctctcacagtattaggtggtagtagttagttcatatattacgnagtacncagtgcgaggggtccattccactatctaccagacgacaaccgacctaaagtaccttaccctagttaactccgtagaccaaaagtcgggaaactacgaccctaggaacgtacggtacggaacgaaccgaccgggacttacgtagttaaattacgtggtacgggtccggggtggccgggttggggggaaccggtagtacggacgaggtccggtacgggggacccgtaaacccggggg

SEQ ID NO: 374625 - DNA, 662 bp, Homo sapiens
  misc_feature: GZ8MTXP02INFP9.21.19.B08.1.454.CMB.2.raw
  modified_base (249)..(249): a, c, t, g, unknown or other
  modified_base (479)..(479): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactatttagaaggtgtccagtgtgaggtgcatctggtggagtcgtgggggagcctggcaagccgtgggggtccctgagactctcctgtgcngcctctggactcccgcccttcacgtacctatagtatgtaattggactccgccacggcctaccggaagggaaggggtcgtagggagtggctctcacagtagttaggtggtagttacgttagttcatattatacgcagtactactagtcgacgagggacctagttccaaacctacttcaccgagaacgaaaccaaccgaacctaaacgtaaacttcccgtagtacttcgtanaaacccgtaaaagtcgaaccgacgtccgagtacggaacggccgggaaacggaccgaacgggtacctttagttaacgttaaccggttattcgggggtcgggtccgggggtcggtacgggggtcgggggaaccggggttgacggaccggagggtcccggtacgggggaacccgtaaccccggggg

SEQ ID NO: 374626 - DNA, 628 bp, Homo sapiens
  misc_feature: GZ8MTXP02FMVXO.21.19.B08.1.454.CMB.2.raw
  modified_base (285)..(285): a, c, t, g, unknown or other
  modified_base (339)..(339): a, c, t, g, unknown or other
  modified_base (583)..(583): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactatttagaaggtgtccagtgtgaggtgcatctggtggagtcgtgggggagcctggtcaagccgtggggggtcctgagactctcctgtgcagcctctggactccgccttcagtacctatagtatanaagttggactccgcgacggctaccgaagggaacggggctggagtggctctacanagtataggtggtagtacgttagtttacataattatacgacagactacgagtgacgacgggcctattccacactctaaccgagaacgacaaaccgacaaacgtaccttcccgtattacgtctagaactaaacgcgaccacgaccgtaggacggtacggaacggaaccggtacacgggtatttaaggtactttaagttaccggtggtgggggtccgggggttggcggggttagggggccggggtanacggaacggcggtaccgggaccgggggtaaccgtaaccccggggg

SEQ ID NO: 374627 - DNA, 668 bp, Homo sapiens
  misc_feature: GZ8MTXP02GM1ZN.21.19.B08.1.454.CMB.2.raw
  modified_base (251)..(251): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtggggaggcctggtcaagccgtgggggtccctgagactctcctgtgcngcctctggactccgccttcagtacctatagtatgaattggactccgccaggcctccgaggaaaggggctggagtggctctcacagtagttaggtaggttagtagttagtttacattatagttacgctagactcagtcgcgacgggccattccactatcctaccagaacgaccaacggaccaagtaacttccctagtacttactgaacctaaagtcgggactacgtacccgtagaacggtacggttacggaaacgggtacccgaaacgggtaccttaaagttacggtttaaacgtttacccggtggttacggggtccgggggttacggggtccggggtttaagggggggccgggggttagtacgggtaacccgacgggggtacccggttacgggggaaccccggttaaaccccggggg

SEQ ID NO: 374628 - DNA, 761 bp, Homo sapiens
  misc_feature: GZ8MTXP02F9BA8.21.19.B08.1.454.CMB.2.raw
  modified_base (281)..(281): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctctgtgcagcctgtggactccgcttcagtacctatatntagatggatccgcaggctaccgaaggaaagggcgtaggagtcggtctctcacgtagtagttaggtggtaagttagtacgtttacaattaattacttaaccggactacggtactacgtagttcggacgaacggggtacccgtacgttacccgtaccctaaactttcccgtaaacccgaaagggaaaccgaaaacccgtaacccggaaacccgtaaaaacggttaacctttacccccgtaggttaaaccttccgtaacgtaaccgtaaaaggttccggaaacgtacgtacccggttaggaacgacgggttaacgaacgggtacccgaaggggtaccttaacgttacgggttaatttaaccggtaggggttcgggtcccgggggtaaggggttcccgggggttaggggggaacccggggttaaggtacggtaacggaacgggggtttccgggtaacccgggggacccggttaaaacccggggg

SEQ ID NO: 374629 - DNA, 601 bp, Homo sapiens
  misc_feature: GZ8MTXP02IH7QX.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggactccgccaggctccgaagggaaggggctggagtggctctcacagtataggtggtagtacgtagtttcattatattacgcagtactcgagtgcgacgggccgtattccgacactctaccagaacgacaaccgaccaaagtacttccctagtactcgtagactaagtcgacacgccgtagaggtagtacggagacgcggtacttaagtacgtattacggtgggtacgggtcggggtacgggtccgggtagggggaaccggggtagtacggacggtacggtccgggtacgggggaccgtaaacccggggg

SEQ ID NO: 374630 - DNA, 635 bp, Homo sapiens
  misc_feature: GZ8MTXP02H4LXB.21.19.B08.1.454.CMB.2.raw
  modified_base (330)..(330): a, c, t, g, unknown or other
  modified_base (624)..(624): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatcgtggtggagtcgtgggggagcctggtcaaggccgtggggggtccctgagactctcctgtgcagcctgtggactcccgtccttacacgtacctatagtatgaagtttcggccgccgtacgcgtaccgaaggggaacgggngtacggtaggtggctctacgacgagtattagtaggtagttagtacgtttacattataacttacgcctagccgtcaagtcggacgaacggccgtacttaccacccgtactcacccgaaggacaaaccgtaaaccgacctaaacgtaaccttccctagtatacttaggaactaaagtcgacacgtcaggaaagcggtaacggaacggtacacggtactagtacgttattaaccggtgtacgggcgggttacggcgggaagggggtcggaaagtccgaaggacggtcgccggggtanaacccggggcc

SEQ ID NO: 374631 - DNA, 599 bp, Homo sapiens
  misc_feature: GZ8MTXP02H9RPD.21.19.B08.1.454.CMB.2.raw
  modified_base (380)..(380): a, c, t, g, unknown or other
  modified_base (408)..(408): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtggggggagcctgggtcaagccgtggggggtccctgagactctcctgtgcagcctctggactcccgccttcagtacctatagtatgaattggactccgccaggcctaccgagggaaaggggctggagtggctctcacagtagttagtggtagtacgtagtttcatattattacgacngactcagtgacgacgggcctatcaaccntcctccagacgaaccacgaccaaagtacttcctagtatctagactaaagtcgggaacagtccgtaggacgtagtcggaaggacacgggtctagtacgttaattacgtcggcgggtcggggtcggtccggtagggggtaacgggggtaactcgggaaacgtgggtacccggtcgggggacccgaaccggggg

SEQ ID NO: 374632 - DNA, 587 bp, Homo sapiens
  misc_feature: GZ8MTXP02IPLG8.21.19.B08.1.454.CMB.2.raw
  modified_base (272)..(272): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatctggtggagtcgtgggggaggcctggtcaagccgtggggggtccctgagactctcctgtgcagcctctggatccgccttnagtacctatatatgaattggatccgccaggcctccgaagggaaggggctggagtggctctcacagtattagtggtagtagttagttcatatattacgcagactcgagtcgcgagggccattccactatctacagacgacaccgacaaagtaccttccagtactctagactaaatggacacgcccgtagacgcgtacgacggacgacggtacttagtagttaactacggttggtcgggtcggggtcggtcgggtacggggggtccggggtagtacggacggacgggtccgggtacgggggacccgtaaaccggggg

SEQ ID NO: 374633 - DNA, 752 bp, Homo sapiens
  misc_feature: GZ8MTXP02F7AGZ.21.19.B08.1.454.CMB.2.raw
  modified_base (557)..(557): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatctggtggagtcgtgggggaggcctggtcaaggtccggtgggggtccctgacgtactctcctgtgcacgcctcgtggactcccgtccttcacgtacctatagtatgtaagttcggactcccgaccgaggcctaccggaaggggaaacggggtcgtagggtacggtcggtaccttcccgtaccgaacgtaagtaacgtttagggttaggttaagttaaggtttagtttacctaatttaaagtttaacttaccgactacgtacctacgtaaggttacgaccggaacgggtcccgtacttaccaaaccttacttacccaccgaagaaccgaaccaaccgacctaaagtaccttacccagttactcgtanaacgtaagtcggaacacgcccgtaggaacgtacgggtaaccgaacggtaccgacgggttaacttaagttacgtttaacgtttaaccgggtgggttcgggggaccggggttcggggtacgggggttacgggggaaccggggtagtaacggacggtacggggtacccgggttacgggggacccggttaaacccgggg

SEQ ID NO: 374634 - DNA, 722 bp, Homo sapiens
  misc_feature: GZ8MTXP02FLSB8.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcacgcctctggactcccgccttcacgtacctatagtatgaattggactccgccaggcctaccgaaggggaaaggggtcagggaggtcggtctccgtacacgtaagtattaggtaggttagttaggttagtttacaattaatactttacgacgagactcgtaggtcgacggtacgggccgtattccacgtatccacagaacgacaaaccgtcaaagtactaccctgtaactctagaaccgtaaagtcggaaccgtagtacccgtaggaaggttaacggtacccggggaaaggttacccgaaaccggggtacttttaaaacgttacgggttttaaagtttaaacccggtagggggttccgggggtccggggggttacggggtacgggggttccggggggggtaagggaaattaccgggggaaaacggcggggtaccgggggtaacccgggggacccgggttaaaacccggggg

SEQ ID NO: 374635 - DNA, 600 bp, Homo sapiens
  misc_feature: GZ8MTXP02GA1ZC.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggatccgcaggctccgagggaaaggggctaggagtggctctcacagattagtggtagtagtagttcattatattacgcagactacaggtgcgaggggccgtattccaccatcctaccagaacgaaccaaccgaccaaaagtaacttaccccgtgttaactcgttaggaacctaaaagtcggaaacacgaccgtgaggagtacggaggacgacgggtctaagttgttaacttacgtgggtacggcggggtacgggcggtgggggaaccggggtatacggacgaggcggtacgggggacgtaaacccgggg

SEQ ID NO: 374636 - DNA, 517 bp, Homo sapiens
  misc_feature: GZ8MTXP02FNELY.21.19.B08.1.454.CMB.2.raw
  modified_base (417)..(417): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtctggggaggcctggtcaagcctggggggtccctgagactctcctgtgcagcctctggatccgccttcagtacctatagtatgaattggatccgcaggctccaggaaaggggctggagtggctcgtcacagattagtggtagtagtagtttcatatattacgcagctcagtgcagggccgattcacatctaccagacacaacgccaaagaattcccngtatctgcaaatggaacagcctgagagtcgagacacggctatgtatacgtgtgacgggtggcgtagggggcggtatcggacaggcgtcggggctaacggg

SEQ ID NO: 374637 - DNA, 710 bp, Homo sapiens
  misc_feature: GZ8MTXP02I4XT6.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctggttttcctagttactattttagaaggtgtccagtgtgaggtgcatctggtggagtcgtggggagctggtcagccgtgggggtccctgagactctctgtgcagcctgtggactcccgccttcgacgtacctagtagtatgtaattggactcccgccaggcctaccggaagggaacggggctggagtggctcctacacgtaagtagtttaggtggttaagtagttagtttacattaacttacgttaccgcgagtactacgtagttcgaccgtacggggtcctaacttacccactactaccctaccgaagtaacggaaacccaaccggacctaaaacggttaactttccccgtagttaaacctcgttaacgaaccgtaaagttcgggaaccaaccgccgtagggaacgtacgggttacggacggtaaaccgacgggtaactttaacgttgttaaacgtttacggttcgggtacggggtaccgggggtcgggtccgggttaggggggaacgggttaagttacgggacccgtacgggtacggggttccggggaccggttaaaacccggggg

SEQ ID NO: 374638 - DNA, 618 bp, Homo sapiens
  misc_feature: GZ8MTXP02IM5Q8.21.19.B08.1.454.CMB.2.raw
  modified_base (405)..(405): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatcgtggtggagtcgtgggggagcctggtcaagccgtgggggtccctgagactctcctgtgcagcctctggactcccgccttcagtacctatagtatgaatggactccgccaggctaccgaagggaaacggggctaggagtggcctctcacagtattaggtggtagtagtagttacatatattacgcagctagagtgcgagggcctattccaaccntcctacaagacgaaccaacgaccaaagtaaccttcccgtatactactgaactaaagtcgggaacagacccgtaggaacgtacggtacgggaaggaaccgacgggtaacttagtacgttacgttacgtgggttggttcgggggtcggtaccggggttggggggaacgggtagtacggaccggtaggccgggtacgggggacccgtaaccggggg

SEQ ID NO: 374639 - DNA, 747 bp, Homo sapiens
  misc_feature: GZ8MTXP02I7UXD.21.19.B08.1.454.CMB.2.raw
  modified_base (255)..(255): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactatttagaaggtgtccagtgtgaggtgcatctggtggagtcgtggggagcctggtcaagccgtgggggtccctgagactctcctgtcgcagcctgnggatcccgccttcacgtacctatagtatgaattggactcccgccgaggcctaccggaagggaaacggggctaggagtcggctcgtacacgtagtacgttaggtaggtagttacgttagttacattatacgttacgactagactcgtaagtcgacgacggggtcctactttaccgacctacttacccgaccgtaaggaaccgtaaaccaaacccggtaccgaaaacgttaacctttacccccgttagttaaccttaccgtaaaggtaccctaaaaggtacgggacaccggtacccgtaggaacggtacggtaaccgggaacggtaaaccgtacgggacccgtttaagttacggtttaaccgttaaggtcgggttaccggggtagggggttacggggtcccgggggttagggggggaacccgggggttaaatccggggaaaacgggtaccggggtttccggggtaacccgggggaaccccggtaaacccggggg

SEQ ID NO: 374640 - DNA, 676 bp, Homo sapiens
  misc_feature: GZ8MTXP02IVAO4.21.19.B08.1.454.CMB.2.raw
  modified_base (250)..(250): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatctggtggagtcgtgggggagcctggtcagccgtgggggtccctgagactctctgtgcngcctcgtggattcccgccttcacgtacctatagtatgtaattggactcccgaccaggctccggaagggaacggggcgtgggagtggctctcacgagtaattagtaggtagttagttagttctaattattacgttacgcagtactcagtgcggagggtccgtaacttccgacctactccgtaccagaacgaaccaaccgaaccgaaataaccttacccgtagttaaactctaggaaactaagtacggggaacacggtaccctaggacgtaagggtacggaacgggacgtaccggggtaactttagtaagtttacgtttaccggtagggttcgggggtcggggttacggggtcgggttaaagggggggccgggtaaggtacgggaaaccgtggggaccgggtcgggggaacccggtaaaccccggggg

SEQ ID NO: 374641 - DNA, 589 bp, Homo sapiens
  misc_feature: GZ8MTXP02I92XG.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgcaggctccgaggaaaggggctggagtgctctcacagtattagtggtagtagttagtttcatatattacgcagtactgagtgacgagggcctataccacatcaccagaagacaacgacaaataactccctagtaactctacgactaaagtcgggaacacgccctaggtaacgaggtaacggaggtaaccgacgggtactagttacgtaatttacgtaggtcggtcggggtacgggcggtaggggggcgggtaacggtggaccggtggaccgggtcggggaccgtaaccggggg

SEQ ID NO: 374642 - DNA, 551 bp, Homo sapiens
  misc_feature: GZ8MTXP02FLWDA.21.19.B08.1.454.CMB.2.raw
  modified_base (401)..(401): a, c, t, g, unknown or other
  modified_base (405)..(405): a, c, t, g, unknown or other
  modified_base (450)..(450): a, c, t, g, unknown or other
  modified_base (540)..(540): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagcctggggggatccctgagactctcctgtgcagcctctggatccgccttcagtacctatagtatgaattggatccgccaggcctccagggaaaggggctgggagtggctcgtcacagattaggtggtagtagtagtttacatatattacgcagtactacagtgcgagggccattccaacnttcnccagacgaccaacgaccaagtaacttcccctagtacttactgganaaaacgtgggaacacgcctaggagtagacgacgacgacggtctagtattacgtactcgtggcgggtggcggtggggacgggactgaacgngcggcggaccg

SEQ ID NO: 374643 - DNA, 803 bp, Homo sapiens
  misc_feature: GZ8MTXP02GSHA3.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggtttcctagttactatttagaaggtgtccagtgtgaggtgcatcgtggtggagtcgtggggagcctggtcaagccgtgggggtccctgagactctccgtgtgcagcctgtgactccgccttcgacgtacctatagtatgtaattcggactcccgaccgaggcctaccggaaggggaaacggggtcgtaggacggtcggtcctaccgtcgaacgtagttaagtttagggtaggttaacggttaaggtttacgttacctaagttaagttacgtttaaccgactacgggtacctacgtaacgggtcgaccgggtaacgggggtacccttaactttacccgaaacctaaacttcccgtaaaccgaaacggtaaccgaaacccgaaacccggaaccaaaacgttaacccgttcccccgtaagtttaacctaccgtacgtaaacgtaaaacggttcggaaaccgtaccggtacccgtaaggtaaggtaacggtaaccggaacgggtaacccgtaaacggggtactttaaaaccgttaggtttaaacgttaccgttaaggggtacggtcccgggggtttggcccgggggtttacggggggaagggttacgttaacgggaacggcgggtacccgggttaccgggggaacccgttaaaccccggggg

SEQ ID NO: 374644 - DNA, 617 bp, Homo sapiens
  misc_feature: GZ8MTXP02HD6G1.21.19.B08.1.454.CMB.2.raw
  modified_base (333)..(333): a, c, t, g, unknown or other
  modified_base (478)..(478): a, c, t, g, unknown or other
  modified_base (517)..(517): a, c, t, g, unknown or other
  modified_base (538)..(538): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatcgtggtggagtcgtgggggaggcctggtcaagccgtggggggtccctgagactctcctgtgcagtcctctggactccgcttcagtacctatagtatgaattggactccgccaggcctcgaagggaaaggctggaggtggctcncacagtagttaggtggttagtacgtagttacatagtattacgcagacctgagtgacgtacgggccacttccaaccgtactacgtcccaagaacgaacgaaccgtacccaaagtaccttcccagttacctgttacgacgttaaacncgaaacgtacgactaggagttagaccggaggacaccgtnttaaagtcgttaaatttcggngggtacgggcggggtacgggcgggtagggggaacggtcgtacgggacggtacggcggggtaccgggaccggtaaccggg

SEQ ID NO: 374645 - DNA, 704 bp, Homo sapiens
  misc_feature: GZ8MTXP02HR7TQ.21.19.B08.1.454.CMB.2.raw
  modified_base (252)..(252): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcncgcctctggactcccgccttcacgtacctatagtatgaattggactccgccgtaggcctaccggaaggggaaggggcgtgggagtcggctctacacgtagtagtttaggtaggtagtagttagttactattattacttacgctagtactcgagtcgacgacgggcctacttccaacctacttccaacgaggaacgaaccaaaccggactaaaagtccttcccgtagtaacttcaggaaactaaaaggtcgggaactacggtaccgtaggaaaggttacgggtcggaaaaggggtacccaccgggttacttaaaggttaggttttaacggttacggttgggggttacgggtccggggggtggtacccggggggttggggggaaccggggttaagtaccggggaaacgggtaccgggcgggggttaacccgggggacccggtaaaacccggggg

SEQ ID NO: 374646 - DNA, 586 bp, Homo sapiens
  misc_feature: GZ8MTXP02FUJVH.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggaggcctggtcaagccgtgggggtccctgagactctcctgtgcagcctctggatccgccttcagtacctatagtatgaattggatccgcaggctccgaggaaaggggctggagtggctctacacagattagtggttagtagttagtttcaatattattacgcagactcaagttgcgtaacgggccgtatttccaaccctatacctacccaaggaacaaacgaacccgacaaagtaaacttccctagttactctagactaaagtgaacagccctagagagtacgaggaacacgggctaagtcgtaaattacgtggacggtcggggttacggcgtagggggcgggagtcgacggaggtccgtacgggggacccaaacgggg

SEQ ID NO: 374647 - DNA, 685 bp, Homo sapiens
  misc_feature: GZ8MTXP02IFVIB.21.19.B08.1.454.CMB.2.raw
  modified_base (247)..(247): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtggggaggcctggcaagccgtgggggtccctgacgactctctgtncgacgcctcgtcggactcccgccttcagtacctatacgtatagaattggactccgaccacggctaccgagggaaacggcgtaggagtcggactcgtacacgtagtagttagtcggtagttacggttagtttactattaacttacgttaaccgacgtacgtactacgaggtacgtaacggacggggtactaccgttaaccacccgattccacccgtaagacgtaacaaccgaacctaaaagtaccttacccgtatacttacgtagaaccgtaaaagcggaacacggtacgttacggggaacgggttacggaccggacgtaccggagttaactttacggtactttacggcggttaggggcggggtacggtcgggggtaggggaccggggtaataccgggagtaccggggtacggtccggggaacggtaaccggtacccgg

SEQ ID NO: 374648 - DNA, 656 bp, Homo sapiens
  misc_feature: GZ8MTXP02HIJHT.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgacgactctcctgtgcagcctctggctcccgccttcacgtacctatagtatgatgactccgccgaggcctaccgaagggaaacggggcgtagggacggtggcctccgtacacgagtaagtttaggtggttaagttagtttagtttacgaattattaattaccgacagtactcaggtcgacgacgggacctattccacctactccacgaagacgacaacgaccaaagtacttcccatactcgtagactaaaacgtgaacagtccgtaggagtaacggtcggaaggaccgtacgggtacttaagtacggtttaacttacgtcggggttacgggccgggggtcgggtacgggggttcggggggaacggggtcttacgggacggacgggtaccgggggtaccggggtacccggtaaaccggggg

SEQ ID NO: 374649 - DNA, 612 bp, Homo sapiens
  misc_feature: GZ8MTXP02HBVT5.21.19.B08.1.454.CMB.2.raw
  modified_base (271)..(271): a, c, t, g, unknown or other
  modified_base (333)..(333): a, c, t, g, unknown or other
  modified_base (344)..(344): a, c, t, g, unknown or other
  modified_base (438)..(438): a, c, t, g, unknown or other
  modified_base (443)..(443): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggtttcctagttactattttagaaggtgtccagtgtgaggtgcatctggtggagtcgtgggggagcctggtcaagccgtggggggtccctgagactctcctgtgcagcctcgtggactcccgccttnacgtacctatagtatgaattggactccgcaggcctaccgaagggaaggctggagtggctctnacagtattagnggtatagtagttacatatatacgcagtactcgagtgacgacgggctacttaccactatccaccgagacgaccaaccgactaaagtaccttccgntaacntagacaaagtcgacacgcctaggacgacggcgaacggactaccgggtcttaacgttagttaaccttggtcgggtaagggtcccgggggttaggaccggggttggggggaaccggttagtacggaaacggacggttccggggtacgggggaacccggttaaacccggggg

SEQ ID NO: 374650 - DNA, 691 bp, Homo sapiens
  misc_feature: GZ8MTXP02FQP31.21.19.B08.1.454.CMB.2.raw
  modified_base (379)..(379): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctctggactccgccttcagtacctatagtatgaattggactccgccaggctccgaaggaaggggcgtggagtcggctcgacacgagtattaggtaggtagtagttagtttcaattatagttacgntacgactcgaagtcgacgacggggtaccgtattccaaccgtacttcccgtacgaacggaacgaaccgaaaccgaccaaacgttaacttcccttaggtacttccgtagaaccaaagtacgggaacctacgtacccgtaggaacgtacggttacggaacggtaccgacggttaacgttagttcggtttaaactttaccggtaggggttcgggtaccggggggttcggaccgggggttacggggggaaccggggtaaggtacggggtaaccggacgggtccggggtaccgggggacccgggttaaaacccggggg

SEQ ID NO: 374651 - DNA, 617 bp, Homo sapiens
  misc_feature: GZ8MTXP02JSLFY.21.19.B08.1.454.CMB.2.raw
  modified_base (345)..(345): a, c, t, g, unknown or other
  modified_base (359)..(359): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatcccgccttcagtacctatagtatgaattggatccgcaggcctcgagggaaaggggctggagtggctcgtcacagtattaggnggtagtagtagttnattattattacgcagtactcgagtcgacgacggggcctattaccacctaatcctaccgacgaacgacaaccgaccgaaagtaaccttacccgtatacttcgtagtacaaagtcggaacgtacgaccgtaggaagtacggtacggaacggtacgacggtacttacgttatacgttacgtaggtcgggtcgggtcgggtagggtcggggggaacgggacggttaggacggaggccggtacgggggaccgaaacccggggg

SEQ ID NO: 374652 - DNA, 670 bp, Homo sapiens
  misc_feature: GZ8MTXP02F9ENK.21.19.B08.1.454.CMB.2.raw
  modified_base (612)..(612): a, c, t, g, unknown or other
  modified_base (634)..(634): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaagtgtccagtgtgaggtgcatctggtggagtcgtgggggaggcctggtcaagccgtgggggtccctgagactctcctgtgcagcctctggactcccgtcttcacgtacctatatatgaattggactccgaccaggccgtaccggaaagggtaaacggggcgtaggggacggtcggtacctcccgtacacgtaagtagttaggtaggttaggttagttagttactattaacgttacgtacgactacgtactacgtacggtcgaccgggacgggtaccttacgtaccacgtacctccgtaacgagaaccgaaccaccgaacctaaacgtacctaccgttataccgtacacgtaaactaaggtaccgaacgaccgtaccgtaggaacgtacggtaacggacgtaaccgaggtactagttacgtacgtttcggtggacggtcggggnggcggggtacggggtggtacgnggaacggtcggtacgggaccgggacggtaaacccgg

SEQ ID NO: 374653 - DNA, 589 bp, Homo sapiens
  misc_feature: GZ8MTXP02G2Q6D.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagcctctggactcccgccttcacgtacctatagtatgaattggactccgccgaggctaccgaagggaagggctaggagtggctctcacgagtagttagtaggttagtagttagtttctatattatacgcagactcagtgacgacgggcctatccactatcctacgagacaacaaccgaccaaagtacttcccgtatactctagactaaagcgaacagcctagagacgtacgaggaccaggtacttagtgttattacggtggtcgggtcggggtcgggtcggtacggggggcggtagtacgggtacgacgggggtcgtacgggggacgtaaacccgggg

SEQ ID NO: 374654 - DNA, 613 bp, Homo sapiens
  misc_feature: GZ8MTXP02JX0K9.21.19.B08.1.454.CMB.2.raw
  modified_base (364)..(364): a, c, t, g, unknown or other
  modified_base (374)..(374): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcagcctcgtggactcccgccttcacgtacctatagtatgaattggactccgccgaggctccgaagggaaggggcgtggagtcggctctcacagtagtagtgtagtagttagttnatatatacgnagtactcagtgacgacgggacctacttcacctatccaaccgagacgacgaaccgaccaaagtaacttcccgtatactcgtagacaaagtggaccagccgtagaggtacggtcgaacggcgacggtacttagacgttaattacggtggtacgggaccggggttcggggcgggttagggggggaacgggtactcggggaacgtacgggtcccgggttacgggggaaccccgtaaccggggg

SEQ ID NO: 374655 - DNA, 690 bp, Homo sapiens
  misc_feature: GZ8MTXP02G948N.21.19.B08.1.454.CMB.2.raw
  modified_base (259)..(259): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgcttgggttttcctagttactattttagaaggtgtccagtgtgaggtgcatcgtggtggagtcgtgggggaggccgtggtcaacggccggtgggggtccctgacgactctcctgtcgcncgcctcgtgactccgtctcacgtacctatagtatagtagttggactccgccgacggcctacggaaggggaaacgggtccgtaggaggtcgcctcctacacgacggtagttaggtaggttaggttacgtttagttactaattagttaatacgacgtacgtactcgaagtcgtacggacgggtccgtacttacccgaactacgttccacgaacgaacgaaaccgaacccgaaccgtaaaacgtaccctttaccgtagtaccttgtacgactaaaggtcgaacgtaacgccggtaagacggacgtaacggcgaacggaccgtagttacgtagttacgtttaggcggggttgggtcgggggtccgggtagggtggggggaaccggtagtacgggaacggcggggtaccgggccggggtaaccggtaaccccgggg

SEQ ID NO: 374656 - DNA, 572 bp, Homo sapiens
  misc_feature: GZ8MTXP02HRPH9.21.19.B08.1.454.CMB.2.raw
  modified_base (329)..(329): a, c, t, g, unknown or other
  modified_base (365)..(365): a, c, t, g, unknown or other
  modified_base (537)..(537): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtgagtcgtggggagcctggtcaagccgtggggggtccctgagactctcctgtgcagcctctggatcccgccttcagtaccctatagtatgtaatggactccgcaggctaccgaggaaagggctggagtggctcncacagattagtggtagtagtagttcatatattacgnagactcagtgcgagggccattcactactctaccagacgacaacgccaaagtacttccctagtactcgtagactaaaagtcggaacacgcctaaggagagtacggaaggaccgacggtactacgtagttagttacgtggttcggcggggtcggaccgggtggggcggggtaancggacgacggtcggtacggggaccgtaacccgggg

SEQ ID NO: 374657 - DNA, 604 bp, Homo sapiens
  misc_feature: GZ8MTXP02IYJQX.21.19.B08.1.454.CMB.2.raw
  modified_base (251)..(251): a, c, t, g, unknown or other
  modified_base (298)..(298): a, c, t, g, unknown or other
  modified_base (323)..(323): a, c, t, g, unknown or other
  modified_base (359)..(359): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactatttagaaggtgtccagtgtgaggtgcatctggtggagtcgtggggaggcctggtcaagccgtggggggtccctgagactctcctgtgcngcctctggatccgctcagtacctatgtatgaattggatccgcaggcncgaggaaggctggagtgctcgtcanagtattagtggtagtagttagttcatattattacgnagactcagtgcgagggcgtatcacatcacagacgacaccgacgaataacttccgtatatctagacaagtacggtacagtcccgtaggaggtaacggtaccggaggtaaaccgtcggtacttaaagtcggtttaaacttccgggttgggttacgggtcgggggttaggggcccggggtttaggggggaaccgggttagtacggggaccgtacgggcggggttaccgggggcccgtaaacccggggg

SEQ ID NO: 374658 - DNA, 805 bp, Homo sapiens
  misc_feature: GZ8MTXP02FW4W0.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtggggagcctggtcaacgccgtgggggtccctgagactctcctgtgcacgcctcgtgactccgccttcacgttacctatagtatagtaagttggactcccgaccgacggtacctacccggaaaggggtaaacggggcgtaggggtacggtcggtccttaccgtaccgaacgtaggttaagtttagggttagggtttaaggtttaaggtttaaggtttttaccaaatttaacgtttaacgtttaaccgaccgtaacggtaccgttacggtaaggttaccggccggtaaccgggggtaccgttaaacgtttacccaaacccgttaccgttacccgtaacccggaaaggtaaaacccgaaaccccgaaaaccccggtaaacccgttaaaaacgttaaccccgtttaccccgttaaggtttaaaccgttcccgttaaagaaaacccggtaaagttaccgggaaaccaccggtacccgtaggaacggtacgggtaacggacggaacgtacgtacttagtacgttattacggtgtacggacggtaggttcggggaggtaacgggggacggtagaccggacggtaacggtccggacggggtaaccccgg

SEQ ID NO: 374659 - DNA, 595 bp, Homo sapiens
  misc_feature: GZ8MTXP02F4ISN.21.19.B08.1.454.CMB.2.raw
  modified_base (329)..(329): a, c, t, g, unknown or other
  modified_base (354)..(354): a, c, t, g, unknown or other
  modified_base (364)..(365): a, c, t, g, unknown or other
  modified_base (450)..(450): a, c, t, g, unknown or other
  modified_base (474)..(474): a, c, t, g, unknown or other
  modified_base (484)..(484): a, c, t, g, unknown or other
  modified_base (514)..(514): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtgggggagcctggtcaagccgtcgggggtccctgagactctcctgtgcagcctctggactcccgccttcagtacctatagtatgaattgatccgacagctcgaggaagggctaggagtgctctacanagtattagtaggtagtagttagttnatatatacgnngactacgagtgcgtaacggggcctagttccaacctagtacctaccaaaggaacgaaccaaccggaccaaaacggtacttaccccngttactctagactaaagtcggganacgctaaggngaggtacgaggtacacgggtactaacgttntagttacgttgggaggtccggggtggcggttaggggggcgggtaatcgggacgtaggcggtaccgggggctaaaccggggg

SEQ ID NO: 374660 - DNA, 578 bp, Homo sapiens
  misc_feature: GZ8MTXP02FPU91.21.19.B08.1.454.CMB.2.raw
  modified_base (329)..(329): a, c, t, g, unknown or other
  modified_base (434)..(434): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggatccctgagactctcctgtgcagcctctggatccgccttcagtacctatagtatgaattggatccgcaggctccgaggaaaggggctggagtggctcncacagtattaggtgtagtagttagttctatatattacgcagactcgagtgcagggcctattcaccatctaccagtacgactaaacgccaaagaacttccctagtntactcgacaaagtcgggacacgcctaggagtagtacggaacgacgaaccggtacttagtacgttaacgttacgtcggtaggggtcgggtcgggcggggtaagggggtcggtaagtcggacgacggcgggtacggggaacccggg

SEQ ID NO: 374661 - DNA, 739 bp, Homo sapiens
  misc_feature: GZ8MTXP02IYXOM.21.19.B08.1.454.CMB.2.raw
  modified_base (247)..(247): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatctggtggagtcgtggggaggcctggtcaagccgtgggggtccctgagactctccngtgcagcctcgtggactcccgtccttcacgtacctatagtatgtaagttggactccgaccgaggcctaccggaagggaaacggggtcgtagggtaggtcggaccttccgtacaacgtagtaagtttaggtaggttaagttacggtttagtttacaatttaacgttaacgttacgtacaggtaccgtacgtaggtcgacggacggggtacctacttaccaactactccgtaccgaacgaacgaaccgaacccgacgtaaacgtaaccttcccgtagtactcgttagacttaaagacgggaacctacggtacctaagggaacgtacggtaaccggacggaaccgtacgggtaactttaggttacggtttaaacttcggtacgggtcgggggtaccggggttagggcccgggggttaaaggggggcccggggtaaaacgttcggaaacgggttcggacccgggggtttaccgggaacccgggtttaacccggggg

SEQ ID NO: 374662 - DNA, 654 bp, Homo sapiens
  misc_feature: GZ8MTXP02JINYY.21.19.B08.1.454.CMB.2.raw
  modified_base (409)..(409): a, c, t, g, unknown or other
  modified_base (516)..(516): a, c, t, g, unknown or other
  modified_base (522)..(522): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggtttcctagttactattttagaaggtgtcagtgtgaggtgcatctggtggagtcgtggggagcctggtcaaggccgtggggggtccctggagtactctccgtgtgcacgcctcgtggactcccgtccttacgacgtacctagtatatagtaattggactcccgacgaggtcctacggaaggggtaaacggggcgtaggtaggtcggccttcgtacaacgtaagtagttaggtaggtagttagttagttacaattatatacgancgtactacgtagtacgacgacggtaccgtattacccgactacgtcctacgaaggaacaaccaccgaacgtaaataccttcccgtagtaactctagaataatcggaancgtacngtaaccggagtacgaggactacggtacttagtacgttaattaccgggtgtaacgggcggggttacgcggggttacggggaacgggattacgggaccgtaaggtcgggttaccggggacccgttaaaccgggg

SEQ ID NO: 374663 - DNA, 603 bp, Homo sapiens
  misc_feature: GZ8MTXP02IJ3J6.21.19.B08.1.454.CMB.2.raw
  modified_base (369)..(369): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtgggggtccctgagactctcctgtgcagcctctggactccgccttcagtacctatagtatgaattggactccgcaggctaccgaggaaagggctggagtggctctacacagtattaggtaggtagtagtagttcatatattacgnagtactcagtgacgaggggcctattaccacgtaactctaccagaacgaacaaacgaccaaaagtacttacccctagtaacttctagaacctaaaagtcggaacaagccgtaagaagacgtaccgaaggaccgtaacggacttagacgttacgttaactaggtacggtccggggtggtacggtagggggaacgggtatacggacgtaggcggtacgggggacccgaaaccggggg

SEQ ID NO: 374664 - DNA, 633 bp, Homo sapiens
  misc_feature: GZ8MTXP02JWNP6.21.19.B08.1.454.CMB.2.raw
  modified_base (255)..(255): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcagctggtggaggtccgggggagcttagtcagccgtgggggtccctgagactctcctgtgcagcctntggtacttcaccctttcagtagctactggatgcacgtcgggtccgccaagcctccggaaggggaacggggctgggtgtggggtctcgtaacgttattaaagtagtgagtgggacgtagcacaagctaccggcggaccgtccgtagggaacgggcccgtattacccgaacctatccctaccaaagacgaaacaaccggaacccaaaagtaaccacggtactagtactacgtacgaacaaaagtacgaaaccgagttccgaaggaacgacggaccggaaggtaaccgacggtcgtagtagttacttacgtggacgacgaacggccccaagaaccgtacggaaactccgaccgagtacggaccgttcggaggggaaacccg

SEQ ID NO: 374665 - DNA, 763 bp, Homo sapiens
  misc_feature: GZ8MTXP02JT3HB.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggactccgccaggctccgagggaaggggctggagtggctctacacgagtaagtttaggtaggttaagttacggttagttttacgtaattaagttaacgtttaacggactacggtacctaccgtaaggttcggaccggtaacgggggtaccccttaacgtttacccaaccctaaacgttcccgtaaccccgaaaggaaacccgaaacccgaaaaccccgggtaaccctaaaacggttaaaaccctttcccccgtaaggtttaaaccttccgttaacggaaacccgtaaaagttccgggaaaccgtaacgtacccgttagggaaacgggtacggtaccgggaacgggtaacccaacggggtaccttagttacgttaaacgttaccggtgggtcgggtcgggggtacggtccggggtggggggccgggtagtacgggaacgcgggtccggtaccgggggaccgtaaacccggggg

SEQ ID NO: 374666 - DNA, 628 bp, Homo sapiens
  misc_feature: GZ8MTXP02HZOBS.21.19.B08.1.454.CMB.2.raw
  modified_base (319)..(319): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctggtttcctagttactattttagaaggtgtccagtgtgaggtgcatctggtggagtcgtgggggaggcctggtcaagccgtggggggtccctgagactctcctgtgcagcctctggactcccgccttcagtacctatagtatgaattggactccgcaggctaccgaggaaaggggcnggagtggctctcactagatttaggtggtagttagtagtttcataattattaccgctagactcagtcgacgacgggccgtattccgacctatcctaccgagaacgaccaaccgacctaaaagtacttcccgtagtaacttcgtagtacgtaaaagtcgggaacacggtaccctaggaagtacggtacggaaacgacgacggtactaacgttagttaacttaacgttggtacggtcggggtcgggccggttggggggaaccgggtattacgggacgtacggtccgggtcgggggaaccgtaaacccggggg

SEQ ID NO: 374667 - DNA, 727 bp, Homo sapiens
  misc_feature: GZ8MTXP02G05ZV.21.19.B08.1.454.CMB.2.raw
  modified_base (559)..(559): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatcgtggtggagtcgtgggggaggcctggtcagccgtggggggtccctgacgactctcctgtgcacgcctgtggactcccgccttcacgttacctatagatagaattggactccgccgaggcctaccggaaggggaacggggctaggggacggtcggtcctaccgtcgaaccgtagtaagtttaagggtagggtttaagttacggtttagttttactaaagttaacgttactttaaccggactacggtacttccgaagtccgggacgtacccgggggtacccgtacttacccgaaccctacttacccgtacccgaaggtaaaccgaacctaaccggacctaaacgtaccttacccggtataactcgttanaacgtaaagttcgggaacgtaacgtccgaagggacggaaccggtacggaagggaacccgaggggtacctttagtacggtttacgtttacggtggggtcggtacgggggtggcggggttcgggggaacggtcgaaggtcgacggtcgggtcggggaaccggtaccgggg

SEQ ID NO: 374668 - DNA, 645 bp, Homo sapiens
  misc_feature: GZ8MTXP02IZW28.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggactccgccttcagtacctatagtatgaattggactccgccgaggcctaccgaagggaaacggggtctagggacggtgggccttcgtcacgtagtaagtttaggtggtaagtagttagtttacaattatattaccgcagaccttcagtgacgacggggcctattaccactatctaccagtaacgaacaaccgacctaaagtaaccttaccctagttactaccgttagactaaaacgtcggaacacgacccgtaggtacggacgtacgggaacggaccgacggacttacgtagttacttacgtggtacgggtccggggtggtaccgggtgggggaaccgggtacggtaggaacgacggtcggtacgggggacccgtaaaccggggg

SEQ ID NO: 374669 - DNA, 717 bp, Homo sapiens
  misc_feature: GZ8MTXP02JEZKY.21.19.B08.1.454.CMB.2.raw
  modified_base (205)..(205): a, c, t, g, unknown or other
  modified_base (327)..(327): a, c, t, g, unknown or other
  modified_base (341)..(341): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgcttgggttttcctagttactattttagaaggtgtccagtgtgaggtgcatcgtggtggagtcgngggggaggcctggtcaacggccgtgggggtccctggacgtactctctgtgcacgctctggatcccgcttcagtacctatagtatgaattggactccgcgagcctaccgaagggaaacgggcnggaggtggccttcnccagagtattagtggttaggtagttagtttcaattattacttacgctaggacttcgagtcgacgaggggcctacttaccaccgtacttccaccgaagaacgaacgaaccgaaccgtaaacgtaacttaccccgtagttactccgtaagtacctaaaagttcgggaaccgtaacggacccgttaagggaaacggttaacgggtaaccgggaacggggtaacccgaacgggtaccgtttaacgttaaaggtttacgtttaaccggttcgggttgggggtacggggttcgggggtaacggtccgggggggttcgggaaaggttcgggtaaaacgcgggttaccgggggaacccggggtaccgggtaaaacccccggggg

SEQ ID NO: 374670 - DNA, 751 bp, Homo sapiens
  misc_feature: GZ8MTXP02I56FX.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggtttcctagttactatttagaaggtgtccagtgtgaggtgcatctggtggagtcgtgggggaggcctggtcaagccgtgggggtccctgagactctcctgtcgcagtcctcgtggactcccgtccttcgacgtacctaatagtatagtaagttcggactcccggacccgaggtcctaccggaaggggaaacggggtccgtaggggtaacggtcgggtccctttaccgtaccgaaccgttaaggttaacgttttaagggtacgggtttaaggttaaccggtttacgtttacctaagtttaacgtttaaccgttaacccgacgtacggtaccttaccggtaaggttccggaccgacgggggtaccctacttacccacctacgttcccaaccgaagaaccgaaaccgaacccgaaccgtaaacgtaaccttacccgttagtaaacttctaacggaactaaagttccgaacgtacgtaccgtagacggtacggtaacggacgaacgtacggtacttaagtacgttaagttcggtaggtcgggtccggggtggcggggttacgggggaacgtacgtacggacacggtcggggtacggaccggtaacccggg

SEQ ID NO: 374671 - DNA, 819 bp, Homo sapiens
  misc_feature: GZ8MTXP02G8M5M.21.19.B08.1.454.CMB.2.raw
  modified_base (188)..(188): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgcttgggttttcctagttactattttagaaggtgtccagtgtgaggtncatcgtggtggagtcgtgggggagtccgtggtcaagccggtcgggggtccctgacgtactctccgtgtcgcagtcctgtcgactcccgtccttcacgtacctatagtatagtaagttggactccgaccgtacggacctaccggaaaggggtaaacggggcgttagggaggtcggccttacccgtacgaaccgtaaggttaagtttaagggttaggtttaaaggttacccggttttaaagtttacctaaaagtttaacgtttaaacgtttaacccgagtacgggttaaccctacgggttaacggttcgggtaccgaaccgggggtaccctaaccgtttacccaaacccgtacttccccgaacggaaaacggaacccgtaaaacccgaaacccggtaaaccccttaaaaggtttaaccccgtttaccccttaaggttaaacccctggtttaaaacggaccgtaaaaggtccggaaaacgtacggtcccgtaaagggtacgacgggtaacggacggtaaaaccgtccggtatttacgtagtttacctacgggtggtacgggtccgggggtggtccggggtagggggaacggttagaccggaagggtcgacgggtccggggacctaaacccgggg

SEQ ID NO: 374672 - DNA, 674 bp, Homo sapiens
  misc_feature: GZ8MTXP02IYSLZ.21.19.B08.1.454.CMB.2.raw
  modified_base (359)..(359): a, c, t, g, unknown or other
  modified_base (633)..(633): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcattcgtgggtggagtcggtgggggaggcctgggtcaaggccggtggggggtccctgacgtactcctccgtgtcgcagtcctcgtggactcccgtccttcacgttacctatagtatagtaagttggactcccgccgacggtccgtaccggaagggaacggggtcgtaggnggtcggctctacagtagtattggtaggtagttagttagttactagttaacttagttaccggactacgtactaccgtaggttcgaccggtaacggggtacctacttaacccgacctactcctaaaccgaggtaaacaaaccgtaccgaaactaaacgtaaccttcccgaattacgtctaacgaactagtcggacacgtctaggagcgtacggacgacgcgtactagtgttaaatcggtggcggtccgggggtaggcggggtagggggaacgggtntcgggacggcggtaccgggtacggggaccgttaacccgggg

SEQ ID NO: 374673 - DNA, 692 bp, Homo sapiens
  misc_feature: GZ8MTXP02F76T8.21.19.B08.1.454.CMB.2.raw
  modified_base (323)..(323): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggctccgccttcacgtacctatagtatgaagttgactccgccaggcctccgaagggaaaggggngtggaggtcggcctctcacgtagtagttaggtaggtagtaggttagtttctaattattaattacgactagtactcgaggtcgacgacggggaccgtattacccgacctaatcccgtaaccaaggacgaaacccaacgtaccaaagtaaccttccctagtactcgtagacctaaagtcgggaacctacgtaccgaggtaacggtacgtaacgggaaggaaccgtaacgggtaccttaaagttacggttaaactttacgtacggggttcggggtaccgggggttaggggtcccgggtaaggggggggtaacggggtaacgttacgggaccgttacggggccgggttaaccgggggccgaaaaccccggggg

SEQ ID NO: 374674 - DNA, 609 bp, Homo sapiens
  misc_feature: GZ8MTXP02ISCLW.21.19.B08.1.454.CMB.2.raw
  modified_base (587)..(587): a, c, t, g, unknown or other
tcagtcgtcgctcgcacgaccggtgctcgatttagtgagtcagtaaggggttgagagaggagccttagccctggattccaaggcctatccacttggtgatcagcactgagcaccgaggattcaccatggaactggggctccgcttgggttttcctagttactattttagaaggtgtccagtgtgaggtgcatcgtggtggagtcggtgggggaggccgtggtcaaggccggtggggggtccctggagactctcctgtgcagtcctgtggactcccgccttcagtacctatagtatgaattgactccgccaggctaccgagggaaagggctggaggtggctctacacagtagttagtggtagtagttagttacatatattacgacagctcagtgcgagggccgattccacctagtcctacgagaagacccaaacgccaaaagtacctttacccgtagtactcgttacactaaagtcggaactacggacctaggaccgtaggtaccggaaggacaaccgggatagttacgtatttacgtaggttcgggacggggtggcgggtgggggtacggggaagtggacgtacggngccggggacgacggggtacccg

SEQ ID NO: 374675 - DNA, 591 bp, Homo sapiens
  misc_feature: GZ8MTXP02JWIAS.21.19.B08.1.454.CMB.2.raw
  modified_base (394)..(394): a, c, t, g, unknown or other
  modified_base (457)..(457): a, c, t, g, unknown or other
  modified_base (469)..(469): a, c, t, g, unknown or other
  modified_base (502)..(502): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatctggtggagtcgtggggagcctggtcaagccgtgggggtccctgagactctcctgtgcagcctcgtggactcccgccttcgagtacctatagtatgaattggatccgccaggctccgaagggaaggggctgggagtggctcgtcacagtattaggtggtagtagttagtttcattatacttacggcaggtactacgagtcgngaggggccctattcccgaccagtctaccagacgaccaacgtacaaagtaacttccctagtacnctagactaaagnggacagcctagacgagtcggaacgtacaccggnttacgttaggttaacttcgttgggacgggtcgggtcggtcgggtacgggggaacggtagtacggacgaggtcggacggggaccgtacgg

SEQ ID NO: 374676 - DNA, 747 bp, Homo sapiens
  misc_feature: GZ8MTXP02HRSES.21.19.B08.1.454.CMB.2.raw
  modified_base (496)..(496): a, c, t, g, unknown or other
  modified_base (673)..(673): a, c, t, g, unknown or other
  modified_base (697)..(697): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggacgtgggctccgcgttgggttttcctagttacttattttagaagtgtccagtgtgaggtgctatcgtgggtggaggttcggtgggggagtccgtggtacaacggtcccggttcggggggtccctggacgtaccttccgttccttggtcgacgtcggtcccttcgtcggacttccccgtccttacgtacgttaccttagttacgtattaggtaagtttacggacctccccgaccggtacggccgtaaccgggaacggggaacggggtcgtaggggtacgtcggttaccgtacgtacgacggtaaaggttaaggtttaaggtaggtttaaagtttaccgtttgtttactacttaaagtttagtacccgntacggtacctgacgtcgacggacggtctacgtccacgtactccagaacgactaacgaaccgacgaaacgttccttaccgtaattcgtaacgttacgaattaagcgtaacgcgtaccgaggaccgtaggaccggtaagaccgtacgtagttagttagttacgtggtcgggttcggggnggggtacggtccgggttagggggnggtaaacgtcggacggtccggggtcgggaaccggggtacccggtaaccgg

SEQ ID NO: 374677 - DNA, 717 bp, Homo sapiens
  misc_feature: GZ8MTXP02JYD22.21.19.B08.1.454.CMB.2.raw
  modified_base (252)..(252): a, c, t, g, unknown or other
  modified_base (257)..(257): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtgggggtccctgagactctcctgtgcngcctntggactccgccttcagtacctatagtatgaattggactccgccaggctccgaagggaaaggggtcagggaggtggcctctacacagtaatttaggtaggtaagttagttagtttacaattattattacgacagtactcgagtgacgacgggaccctattacccacctatcccgtaccgaagaacgaaccgaaccgaaccaaacgtaaccttacccgtagttaaacttcgtaaggtaacctaaaaggtcgggaaaacccgtagtacccgttagggaaacgggtacggtaacgggaacgggtaaaccggtaccgggtacttaaagtttacgggttaacgttttaaccggtaggggttcggggtcgggggttcggggtacggggttacgggggggaacggggtacggttacggaacggttaccggggccgggttaccggggggaacccgttaaacccgggggg

SEQ ID NO: 374678 - DNA, 667 bp, Homo sapiens
  misc_feature: GZ8MTXP02H392K.21.19.B08.1.454.CMB.2.raw
  modified_base (351)..(351): a, c, t, g, unknown or other
  modified_base (388)..(388): a, c, t, g, unknown or other
  modified_base (391)..(391): a, c, t, g, unknown or other
  modified_base (395)..(395): a, c, t, g, unknown or other
  modified_base (411)..(411): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctccgtgtgcacggtccctgtgggtactcccggtcccttcagtacccttaagtacgtatagtaattggactccgccaggcctaccgagggaaaggctaggagtcggctntacacagtataggtgtagagtagttcatatattacgntanactnagtcgagacgggaccnttccaccattccgaccagaacgaccaaacgaccctaaagtaaccttcccgtgtaacttctaggaactaaagttacggaccgacgtaccgtaggaaacgttcggaacggacggtaacgtaaccgggacctttaagtacgtttaacgtaactttccggggggtcggttaccgggggtcggggtaacgggggtacgggggtaacggggtacgtacgggtacggtacggggtccgggtaccggggaacccggtacggggg

SEQ ID NO: 374679 - DNA, 699 bp, Homo sapiens
  misc_feature: GZ8MTXP02I4J5V.21.19.B08.1.454.CMB.2.raw
  modified_base (286)..(286): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatcgtggtggagtcgtggggacgccgtggtcaagccggtcgggggtccctgagactctctgtgcacgcctcgtcggactccgcttcagtactatagtntagaagtgactccgcgacggcctaccggaaagggaacggggtctggaggtcgaccttcgcgaactagtagtttaggtagggttaagtagttacgtttacgtattaacgttaacgtaccgacgacgtacgtcgtaaggtccgtacgggaacggggtaccctaacgtttacccaaaccttacgttacccgacccggaaagaacccgtaaaacgtaccccgaaccgtaaaagttaacccttacggtacttaacgtacttacgaaacttaaacgacgggtaacacggttaccaggtaaggacgtacgggaacgtacgaacgtagtagtacgttattacggtacggtcgggcggggttcggtcggagggggttaacggaagtgacggtacggaccggacggggtaacggtaacccggg

SEQ ID NO: 374680 - DNA, 583 bp, Homo sapiens
  misc_feature: GZ8MTXP02FKEP3.21.19.B08.1.454.CMB.2.raw
  modified_base (332)..(332): a, c, t, g, unknown or other
  modified_base (370)..(370): a, c, t, g, unknown or other
  modified_base (384)..(384): a, c, t, g, unknown or other
tcagtcgtcgctcgcacgaccggtgctcgatttagtgagtcagtaagggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagctctcctgtgcagcctctggatcccgcttcagtaccctatagtatgaattggatccggccaggctccgaggaaaggggctggagtggctcncacagtattagtggtagtagtagttcatatattacgcngactcagtcgacgngggccgagttacaccacgttcctaccgagaagacaaccgaccaaagtaccttcccgttagtaactcgtagtaccaaagtcgggaaccagtacccgtagaggtacgtcggacggacgacgggtactagtagttacttacgtgtacggtcggggtacgcggttagggggcggagtcgagacgcggtcgggacgtaaccggg

SEQ ID NO: 374681 - DNA, 711 bp, Homo sapiens
  misc_feature: GZ8MTXP02GSRWE.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggttttcctagttactattttagaaggtgtccagtgtgaggtgcatctggtggagtcgtggggagcctggtcagccgtgggggtccctgagactctcctgtgcagcctctgactccgccttcagtacctatagtatgaattgactccgcaggcctcgaaggaagggctaggacgtggcctctcgaactagtacgtaggtggtagtacgttagtttacattatacttacgcgtagtcgtacaggtcgacgtaggggtacctattacccaccgtactaccgttacccaaggacgaaaccaaccgacctaaaacgtactttacccctaggttaactccgtagtaaccgaaaagttagggaacccgtaacgacccgttaaggaacggtaacggttacggaaaccggaaccgaccgggttactaagttccggtttaaaagtttcggttaacggggcggggtttacccgggggttacggggccggggttacggggggaaacccgggggtttagtaaccggggaaacctttcggggaccgggttaaccgggggaccccggttaaaccccggggg

SEQ ID NO: 374682 - DNA, 723 bp, Homo sapiens
  misc_feature: GZ8MTXP02IUG83.21.19.B08.1.454.CMB.2.raw
tcagtcgtcgctcgcacgaccggtgctcgatttagtgagtcagtaagggctgagagaggagccttagccctggattccaaggcctatccacttggtgatcagcactgagcaccgaggattcaccatggaactgggctccgctgggtttcctagttactattttagaaggtgtccagtgtgaggtgctatctggtggagtcgtggggacgcctggtcaagtccgtgggggtccctggacgactctccgtgtcgcagcctcgtggactcccgtccttcagttacctattagtatgaaatttcggactccgaccgaggtcctaccggtaaggggaaacggggtctacggggaggtcggtaccttacgtcaccgtaaggtaactttagggtaggttaacggttagttaacgttaccgtattaacgttacgttaccgactaggtaaccctagtacgttaggaccgtacgggggtaacctactttacccgactaacgttccctaaaccgagtaaacccgaaaccaacccggacctaaaacggtacctttacccgtagtacctacgttcggaaacctaaagtcggaacacgccgtagacgtacggtacgaccggtaaacgtcggtaacttggtaacttacgttaccgtaggttcgggtcggggtaacggtccggtagggggtaacccggagtaccgtacgcggttaacggtcgggaaccgtaacccgggg

SEQ ID NO: 374683 - DNA, 614 bp, Homo sapiens
  misc_feature: GZ8MTXP02GKMTC.21.19.B08.1.454.CMB.2.raw
  modified_base (489)..(489): a, c, t, g, unknown or other
  modified_base (550)..(550): a, c, t, g, unknown or other
  modified_base (571)..(571): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggtttcctagttactattttagaaggtgtccagtgtgaggtgcatctggtggagtcggtgggggagcctggcaaggccgtggggggtccctgagactctcctgtgcagcctcgtggactcccgtcttacacgtactatagtatgaatggactccgccaggcctacggaagggaagggtctggagtcggctcacacgagtagttaggtaggttagtacgtagtttacaagttattaacgttaccgactagtaccttacgaggtcgccggaacgggtaccgttaatacccaacctactcccacgaagaacgaaaccaaccgtacaaacgttactcctagtaactnagaaccaagtacgagtacgtcctaggagtacggtagacgaccgagactatacgttattcgnggtaggcgggtacggacgggngggggtaagtcgaggacgtaggcggtacggggaccgtaaccgg

SEQ ID NO: 374684 - DNA, 744 bp, Homo sapiens
  misc_feature: GZ8MTXP02HCG7H.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgcttgggttttcctagttactattttagaaggtgtccagtgtgaggtgcatcgtggtggagtcggtgggggagccgtggtcagccggtcgggggtcctgagactctcctgtgcacgcctcgtcggactccgtccttacacgtacctatagtatagtagttggactccgccgaggcctaccggaaggggaacggggcgtagggtacggtcggctccgtacacgtagtaagttaggtaggttagttagttatttacgtattaatttattacgactacgtactacgagtcgacgtacgggccgtacttaccaacctaaccgttcctaaaccgaaggtaaaccgaaaccgaacccggtaacctaaaacgttaaccgtttacccctaggttacttacgtaacgtaacgtaaaagtcgggaaacaccgtacgtaagggtaacggtaaagggtccggaaaacggggacccgtaacggttacgttagttaacggtttagttaccgggttaggggtccgggggttcgggggtacggggtcggggttaggggggaaccgggtgtaacgggaccggagggtcccggggtccgggggaaacccgtttaccggggg

SEQ ID NO: 374685 - DNA, 686 bp, Homo sapiens
  misc_feature: GZ8MTXP02FIQTR.21.19.B08.1.454.CMB.2.raw
  modified_base (571)..(571): a, c, t, g, unknown or other
tcagtcgtcgctcgcacgaccggtgctcgatttagtgagtcagtaaggggctgagagaggagccttagccctggattccaaggcctatcccacttggtgatcagcactgagcaccgaggattcaccatggaactggggctccgctgggttttcctagttactattttagaaggtgtccagtgtgaggtgcatcgtggtggagtcgtgggggagccgtggtcaagccgtgggggtcctgacgactctcctgtcgcacgtcctcgtaggactcccgtcttacacgtactaatagtatagaattggactccgccgacggctcgaagggaacgggtcgtggagtcggtcgtctacacgtagtagtagtaggttagtacgtagtttacaattataacttacggactacgactcgtagtacgacgtacggggacctacgtaccacctacgtccaccgaacggaagtaaacccaaccggaccgtaaaacgtaccgttaccccctagttacttaccgaggtaaccaaagttcgggtaaccagacccgtaggaacgtcgggaacgacggaacgttacggntaacgtaggttactttaccggtaggtccggtacgggggtactccgggggagggggtaagggggtaacggtacggacggtacgggtacggtacgggggtaccgggtaaccccgggg

SEQ ID NO: 374686 - DNA, 658 bp, Homo sapiens
  misc_feature: GZ8MTXP02JTFYS.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagccgtggggggtccctgagactctcctgtgcagccctgtcggactcccgccttcacgtaccttatagtatgaattggactccgccgaggcctaccggaagggaaacggggctagggagtggcctctccacgtagtagttggtaggtagttagttagttacattattacttacgactagacctgtagtgacgaacggggtcctagttccaacctctccgtaccgagaacgaaaccgaaccgaccaaacggttaccttacccctaggttacctcgttaacggaactaaaacgttcgggaaaccacggtacccttaggaaggtaacggtacggaaacgtacggaaccgttgtagttacgttacgttaccgtgggtcgggtcggtcgggtcggtcgggggaaggtagtacggacggagtccgggacgggtacgaacccgggg

SEQ ID NO: 374687 - DNA, 773 bp, Homo sapiens
  misc_feature: GZ8MTXP02GTQB4.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgagtattcaccatggaactggggctccgctgggttttcctagttactattttagaagtgtccagtgtgaggtgcatcgtggtggagtcgtgggggagcctggtcaagccggtgggggtccctgacgactctcctgtgcagcctcgtggactcccgtaccttacacgttaccctaagttagttattaggtaaagtttcggacgtcccgaccgacggtcctaccgggaaaggggaaacggggccgtaggggtagttcgggtccttccctacgtaacgaggttaaagtttagggtacggtttaagtaaggtttaagttttactaaagttaacttaacgtttaaccgactacgtaccttacgacggttacgaccggaacggggtaccgtaccttacccaaccttacgtaccctaccgaaacggaaacgaaacccgaaacccgtaccgtaaaaccggttaaccctttacccgtacgttaaacttccgtaagaaccgtaaaagtaccggaacgtaccgtacccgtaaggtaagtaccggtacgggaacgtaaccggacggtattaacggtaggttacttacggtgggtacgggtccggggttgggcgggttccgggggaaggttagacggtacgcgggtacggtcggggacccggttaaccgggg

SEQ ID NO: 374688 - DNA, 709 bp, Homo sapiens
  misc_feature: GZ8MTXP02GNKBJ.21.19.B08.1.454.CMB.2.raw
tcagtcgtcgctcgcacgaccggtgctcgatttagtgagtcagtaaggggctgagagaggagccttagccctggattccaaggcctatccacttggtgatcagcactgagcaccgaggattcaccatggactgggctccgctgggtttccagttactattttagaaggtgtccagtgtgaggtgcatcgtggtggagtcgtggggagcctggtcaagccgtgggggtcctgagactctccgtgtgcacgcctctggactcccgtccttcaacgttaccctaagtacgtagtacgtaattggactcccgaccgacggtccgtaccgaaggggtaaacggggctaggggacggtcggcttccgtacacgaggtacgttaggtggttaacgtagtttacgtttacgagttaattattaaccgacagtacctccgaaagtgaccggtacggggtacccagttacccgacctacgtacctaccgaagaaccgacaaaccgacctaaacggaactttaccccgagttactactacgggtaactaaagtacggtaccgaagtacgtaacgacggtaggtaaccgtaaggaccgtaacgggtcctaagttacgttacgtttaacggtcgggtacgttcgggggtaacggttccgggttaggggggccggtagtaccggggagtaccggacgggttcggggacccggtaacccggggg

SEQ ID NO: 374689 - DNA, 675 bp, Homo sapiens
  misc_feature: GZ8MTXP02IUTS7.21.19.B08.1.454.CMB.2.raw
  modified_base (331)..(331): a, c, t, g, unknown or other
  modified_base (349)..(349): a, c, t, g, unknown or other
  modified_base (377)..(377): a, c, t, g, unknown or other
  modified_base (441)..(441): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactgggctccgctgggtttcctagttactattttagaaggtgtccagtgtgaggtgctatctggtggagtcgtgggggagcctggtacaagccgtgggggtccctgagactctctgtcgcagcctcgtggactccgtccttctagtacctatgtactgtaagttggactcccgacctaggtcctaccgaagggaaacgggntggagtcggcttcacganagtagttacggtggtagtagttacgttnattacttattacgcacggtactcgagtcgacggtacggacctagttccaaactctcgtaaccgngaaaccgacaaaccgtaccgtaaacgaaccgttccgtattactactacgaaactaagtacggacgtacgtaccgtagggacgacgtacggacggtaaacctacgggtaccttaggtacgtttacgtttaaacgggtcggttacggggtacggggtgggtaaaccggggcgggggttaacggaacggttggaaaccggtaccggggtacggtaccccgggaacgggtaacccggg

SEQ ID NO: 374690 - DNA, 697 bp, Homo sapiens
  misc_feature: GZ8MTXP02IDA4Z.21.19.B08.1.454.CMB.2.raw
  modified_base (143)..(143): a, c, t, g, unknown or other
  modified_base (209)..(209): a, c, t, g, unknown or other
  modified_base (268)..(268): a, c, t, g, unknown or other
  modified_base (616)..(616): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgntgggtttcctagttactatttagaaggtgtccagtgtgaggtgcatcgtggtggagtcgtgggggngcctggtcagccgtgggggtccctgagtactctcctgtgcagcctcgtgctccgtcttnagtacctatatatgtaagttggactccgccgtaggcctaccggaagggaaacggggcgtagggtaggtcggtcctcgtacgtaacgtgtaagtttacggttaggtaaggttaccgttagttttacatttaacttagttacgactagtctaccgaggttacgcgtacggggactacttaccgacctactccgtaccgaaaggaacgaaacccgaacgaaaccggtaaacgttaaaccttcccgttagtaaccttccgtaagtaacccgtaaagtcgggaactaacggtcgtagacggtaagtacggaacgtaccgtacgggtcttaaagtcgtacgttaacggttcggnggtacgggggtcggtcgggggtacgggggtaaccggaggtacggacgacgggtccggggtacggggacccggtaaccgggg

SEQ ID NO: 374691 - DNA, 592 bp, Homo sapiens
  misc_feature: GZ8MTXP02FNK33.21.19.B08.1.454.CMB.2.raw
  modified_base (256)..(256): a, c, t, g, unknown or other
  modified_base (553)..(553): a, c, t, g, unknown or other
tcagtcgtcgctcgcacgaccggtgctcgatttagtgagtcagtaaggggctgagagaggagccttagccctggattccaaggcctatccacttggtgatcagcactgagcaccgaggattcaccatggaactggggctccgctgggttttcctagttactattttagaaggtgtccagtgtgaggtgcatctggtggagtcgtgggggagcctggtcaagcctggggggtccctgagactctcctgtgcagcctngatccgcttcagtacctatagtatgaattgatccgcaggctcgaggaaggctggagtggactctcacgtagattagtggtagtagttagtttcattaatattacgcagtactacgagtgcgagggtacccgattccacccaatcctaccgagaacgtaccaaacggaccaaagtaaaccttcctagttaactctagacctaaagttggaaacaggtaccctaggagtacggtacggaggaaccgtacggactttagtagttaacttaacgttggtggacgggtgggcgttagggggnggtacgtagaacgtcggacgtcgggggaccgtaacgggg

SEQ ID NO: 374692 - DNA, 552 bp, Homo sapiens
  misc_feature: GZ8MTXP01BQ5WT.22.15.B04.1.454.CMB.2.raw
  modified_base (247)..(247): a, c, t, g, unknown or other
  modified_base (413)..(413): a, c, t, g, unknown or other
tcagacatacgcgtcacgaccggtgctcgatttagacagtatatatccgcgggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactntgtctctggtaccaacagcacccaggcaaacgcccccagactcatcatttatgctgtcaataacgcggccctcgacgggggtccctgactcccgcttctctggcctacccaagtctgggccaaacaccggccctccctgacccatctctgggctccaggctgaagntgagctagacttattactgctgtctctatttgcacggtccgtcctactacgttggggtcgttcggggcgggttagggacccaaggccgttcgacccgtccgtaggtcacggaccccgaagggtccgttccggtcccccg

SEQ ID NO: 374693 - DNA, 501 bp, Homo sapiens
  misc_feature: GZ8MTXP01BA7Q6.22.15.B04.1.454.CMB.2.raw
  modified_base (292)..(292): a, c, t, g, unknown or other
  modified_base (310)..(310): a, c, t, g, unknown or other
  modified_base (393)..(393): a, c, t, g, unknown or other
  modified_base (440)..(440): a, c, t, g, unknown or other
tcagacatacgcgtcacgaccggtgctcgatttagacagtatatatccgcggggtctcaggaggcagcgctctcaggacgtcaccaccatggcctgggctctgctcctcctcagcctcctcactcagggcacagggtcctgggcccagtctgccctgactcagcctcctccgcgtccggtctcctggacagtcagtcaccatctcctgcactggaaccagcagtgacgttggtgttataactatgtctctggtaccaacaacaccaggcaaagcccccaaatcatgatttangagtcactaagcggcctnagggtccctgatcgcttctcctggctccaagtctagggccaacacggccctccctgacccgtctctgggctccaggctgaggntgagctgattatactgcaggctcatatggagcagccgataagtttgngttcggcggaggaccaagctgaccgttccttggcaagcccaaggctgcccctggttcaacc

SEQ ID NO: 374694 - DNA, 515 bp, Homo sapiens
  misc_feature: GZ8MTXP01DRZKU.22.15.B04.1.454.CMB.2.raw
  modified_base (418)..(418): a, c, t, g, unknown or other
  modified_base (423)..(423): a, c, t, g, unknown or other
  modified_base (443)..(443): a, c, t, g, unknown or other
tcagacatacgcgtcacgaccggtgctcgatttagacagtatatatccgcgggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacaacacccagcaaagcccccaaatcatgattatgaggtcactaagcggccctcaggggtccctgatcgcttctctggctccaagtctggcaacgacggcctccctgacccgtctctgggctccgaggctgaggatgaggctgattatactgcagctnatagnggagcagcactaagtttggngttcgggcggtagggaccaagctgaccgttccgttggttcaagcccaaggcctcgccccctggttctaaccg

SEQ ID NO: 374695 - DNA, 556 bp, Homo sapiens
  misc_feature: GZ8MTXP01A7FL0.22.15.B04.1.454.CMB.2.raw
  modified_base (248)..(248): a, c, t, g, unknown or other
  modified_base (352)..(352): a, c, t, g, unknown or other
  modified_base (424)..(424): a, c, t, g, unknown or other
tcagacatacgcgtcacgaccggtgctcgatttagacagtatatatccgcgggggggtctcaggaggcaacgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttacaagtntgtctctggtaccaacaccaccaggcacacgcccccaaatcatgatttatgagtcactaagcgggctcgacgggtcctgatcgcttctctggctcagtctggcncacggcctccctgaccgtctcgtgggcctcgaggctgaggatcggagctgattatctgctactcatagtcgntaggcgactaacgttcgttgggtgttccgggcgggtaacgggacccaaggtcgttacggtacccggtccgttacgggttccacgggccccgaaggcccttccggccccccgttggtcccttaaccgttcccg

SEQ ID NO: 374696 - DNA, 517 bp, Homo sapiens
  misc_feature: GZ8MTXP01CDAR6.22.15.B04.1.454.CMB.2.raw
  modified_base (298)..(298): a, c, t, g, unknown or other
  modified_base (338)..(338): a, c, t, g, unknown or other
  modified_base (453)..(453): a, c, t, g, unknown or other
tcagacatacgcgtcacgaccggtgctcgatttagacagtatatatccgcgggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttgatggttataactatgtctcctggtaccaacaacacccaggcaaagcccccaaatcatgatttangagtcactaagcggccctgaggggtccctgatcgcttccnctggctccaagtctggcaacacggccctccctgaccgtctctgggctccgaggctggagatggaggctgattatactgcagctcatagtggaggcaaggcctaataagtttgggngttcgggcgggagggaccaagctgaccgttcttagggtcagcccaaggcttcgccccttggtcc

SEQ ID NO: 374697 - DNA, 550 bp, Homo sapiens
  misc_feature: GZ8MTXP01AGDRU.22.15.B04.1.454.CMB.2.raw
  modified_base (239)..(239): a, c, t, g, unknown or other
  modified_base (373)..(373): a, c, t, g, unknown or other
  modified_base (462)..(462): a, c, t, g, unknown or other
tcagacatacgcgtcacgaccggtgctcgatttagacagtatatatccgcggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccagcagtgacgttggtgttanactatgtctctgtaccaacacaccaggcaaagcccccaaatcatgatttatgaggtcactaagcggccctgacggggtccctgatcgcttctcctggctcaagtctaggcaacacggccctccctgacccgtcncgttgggcctccgaggctggacggatggaggctgatttattacgtgccagggtctacgatagtcggaagcaacccggataagtttgggngttccgggcggaagggaacccaaggccttaggaacccgtcgttagggttccacggcccaaggcctcgcccccttggtccaacgttccg

SEQ ID NO: 374698 - DNA, 536 bp, Homo sapiens
  misc_feature: GZ8MTXP01EWLHA.22.15.B04.1.454.CMB.2.raw
  modified_base (224)..(224): a, c, t, g, unknown or other
  modified_base (248)..(248): a, c, t, g, unknown or other
  modified_base (300)..(300): a, c, t, g, unknown or other
  modified_base (447)..(447): a, c, t, g, unknown or other
  modified_base (453)..(453): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttacaagtntgtctctggtaccaacaccacccaggcacacgcccccaaactcatgatttangagtcactaagcgccctcgacggggtccctgactcgcttcctctggctccaagtctggcaacacggccctccctgacccatcctctgggcctccgaggctagaagagtgaggtctgtattattactgggtctgctcatttgcaggcncctacncgttgggtcgtcggcggacggaccaaggcgtcgaccgttcgttacggtcgacgcccgaaggccttccgtccccgttcggtccc

SEQ ID NO: 374699 - DNA, 572 bp, Homo sapiens
  misc_feature: GZ8MTXP01CRGFG.22.15.B04.1.454.CMB.2.raw
  modified_base (250)..(250): a, c, t, g, unknown or other
  modified_base (265)..(265): a, c, t, g, unknown or other
  modified_base (299)..(299): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtgttaataactntgtctctgtaccaanaacaccaggacaaacgccccaaatcatgatttangaggtcaactaagcggccctcgacggggtcctgactcgcttctcctggctcaagtctaggacaacgacggccctcccgtgacccgtctcgtgggcctcgaggctgaggatggaggctagattatctgcaggtctacatagtcggagcgagacgtaacgtagtttgggtcgttcgggcgggtaacgggaccgaagcgttacggacccgttaccgttggttaccgaacggtacccgaacgggtcctccggccccccgttcggttcccgtaacccg

SEQ ID NO: 374700 - DNA, 537 bp, Homo sapiens
  misc_feature: GZ8MTXP01ESQNX.22.15.B04.1.454.CMB.2.raw
  modified_base (248)..(248): a, c, t, g, unknown or other
  modified_base (296)..(296): a, c, t, g, unknown or other
  modified_base (462)..(462): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctctggtaccaacaacaccagcaaacgccccaaatcatgatttangaggtcacgtaagcggccctcgacggggtccctgactcgcttctcctggctccaagtctacggacaacgaccggccctccctgacccgtctcgtcgggcctcgaggctgaggatggaggtctgattatactgcagggctcatagtggagcagacgtataagttggngttcgggcggtagggaccagcgtggaccgttcgttggttccaagacccgaaggcctcgcccctggttctaacccg

SEQ ID NO: 374701 - DNA, 516 bp, Homo sapiens
  misc_feature: GZ8MTXP01B0BYG.22.15.B04.1.454.CMB.2.raw
  modified_base (247)..(247): a, c, t, g, unknown or other
  modified_base (298)..(298): a, c, t, g, unknown or other
  modified_base (406)..(406): a, c, t, g, unknown or other
  modified_base (434)..(434): a, c, t, g, unknown or other
  modified_base (457)..(457): a, c, t, g, unknown or other
  modified_base (463)..(463): a, c, t, g, unknown or other
  modified_base (484)..(484): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctctggtaccaacaacacccaggcaaacgcccccaaatcatgatttangagtcactaagccgccctcgacgggtccctgatcgtcttctcctggctccaagtctaggcaacgacggccctccctgacccgtctcgtcgggctccgaggctggaggntaggaggctagattatactgcaggctanatagtggagcagcatagtttggngtcggnggaggcagcgtgaccgttcgngcaacgcccgaagcctcgccccgtgttctccg

SEQ ID NO: 374702 - DNA, 584 bp, Homo sapiens
  misc_feature: GZ8MTXP01EBM1C.22.15.B04.1.454.CMB.2.raw
  modified_base (249)..(249): a, c, t, g, unknown or other
  modified_base (277)..(277): a, c, t, g, unknown or other
  modified_base (295)..(295): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagccctcctcactcagggcacagggtcctgggcccagtctgccctgactcagcctccctccgcgtccgggtctcctggacagtcagtcaccatctcctgcactggaaccagcagtgacgttggtgttataactntgtctctgtaccaacaacaccagcaaanccccaaatcatgatttangagtcactaagccgcctcgacggggtcctgatcgcttctcctggctcaagtctaggaccaacgacggccctcccgtagcccgtctcgttcgggcctccgaggtcctaggaggattggaggtctaggattacttacgtgccaggtcctgtaatagtggagcaggtaccgtaattaagttttgggtcgttcggggaacggaaggggacccaaaggttccgtaggtacccgttcgttagggttccaaccggacccgtaacgggcctcccggcccccttcggttcctaacccg

SEQ ID NO: 374703 - DNA, 606 bp, Homo sapiens
  misc_feature: GZ8MTXP01C3045.22.15.B04.1.454.CMB.2.raw
  modified_base (293)..(293): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcacgcctccctccgcgtccgggtctcctggacagtcagtcaccatctcctgcactggaaccagcagtgacgttggtgttatactatgtctctgtacaacaacaccagcaaacgccccaaatcatgattangaggtcactagcgcctcgacgggtcctgatcgcttctcctcggctccgaagtctggaccaacgaccggccctcccgtcgacccgtctcgtcggcctcgaggctggagagtgaggtctagattattactgcaggtctacgtagtacgtagggacgcgagtaccgagttaagtttgggtcggtttccggggaacgggtaacggggaaccgtaaacgggcgttaaccgggtacccgtttaccgttcgggttaccgaaccgggtaccccgaacgggtcccgtcccggttaccccccgttcgggttcccttaaccccg

SEQ ID NO: 374704 - DNA, 561 bp, Homo sapiens
  misc_feature: GZ8MTXP01ESZ2U.22.15.B04.1.454.CMB.2.raw
  modified_base (249)..(249): a, c, t, g, unknown or other
  modified_base (297)..(297): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtntgtctctgtaccaacaccaccagcacacgcccccaaatcatgatttangaggtcactaaggcggccctgagggggtcccctgatccgcttcctcgtggctaccaagtctggcgacaccggccctccctgaccgtctcgtgggctccgaggctgaggatgaggctagtattagttactgcttactcatagtgcgaggcggacacgttgttgggtcgttcgggcgggacggaccgaagccgtacggtacccgttcgttacgggcctaacgggccctaagggccctccggcccccgttcgggttcccttaacccg

SEQ ID NO: 374705 - DNA, 610 bp, Homo sapiens
  misc_feature: GZ8MTXP01C07C8.22.15.B04.1.454.CMB.2.raw
  modified_base (246)..(246): a, c, t, g, unknown or other
  modified_base (292)..(292): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagccctcctcactcagggcacgagggtcctgggcccagtctgccctgactcagcctccctccgcgtccggtctcctggacagtcagtcaccatctcctgcactgaaccagcagtgacgttgtgttatactntgtctctgtacaacaacaccagacaaacgccccaaatcatgattangagtcacgtaagccgcctcgacgggtcctgactcgcttctcctcggctcaagtctacggaccaacgaccggccctcccgtcgaccccgtctcgtcgggcctccgaggtcgtaggacggagtggacggtctagtattacgtactgcaggtctacgaatagtggacgcgagcgtaacgtaagtttgggtcggttcgggcgggtaacgggacccgtaaaggccgttaccggaacccgttcccggttacgggttcccgaaaccggtaccccgaacgggtccccgttcccggaccccccgttccggttaacccgttaaccccg

SEQ ID NO: 374706 - DNA, 522 bp, Homo sapiens
  misc_feature: GZ8MTXP01B0ZXP.22.15.B04.1.454.CMB.2.raw
  modified_base (226)..(226): a, c, t, g, unknown or other
  modified_base (265)..(265): a, c, t, g, unknown or other
  modified_base (296)..(296): a, c, t, g, unknown or other
  modified_base (426)..(426): a, c, t, g, unknown or other
  modified_base (429)..(429): a, c, t, g, unknown or other
  modified_base (440)..(440): a, c, t, g, unknown or other
  modified_base (446)..(446): a, c, t, g, unknown or other
  modified_base (461)..(461): a, c, t, g, unknown or other
  modified_base (468)..(468): a, c, t, g, unknown or other
  modified_base (506)..(506): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagccctccctccgcgtcccgggtctcctggacagtcagtcaccatctcctgcactggaaccngcagtgacgttggtgttataactatgtctctgtaccaanacaccagacaaacgccccaaatcatgattangagtcataagccgcctgacgggtcccagactcgcttctccgtcggctaccgaagtctaacggaccaacgacgccacgtcccctgacccgtctcgtgggcctccgaggctggaggatggagtctgattatngcngtctcataggngacganagcgtagtagttggnggtcggnggacgacagcgtcgaccgttcgagcacgccgacgtccncccgtcccgttcgtcc

SEQ ID NO: 374707 - DNA, 603 bp, Homo sapiens
  misc_feature: GZ8MTXP01C1VR4.22.15.B04.1.454.CMB.2.raw
  modified_base (293)..(293): a, c, t, g, unknown or other
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttatactatgtctctgtacaacaacaccagcaaacgccccaaatcatgattangagtcacgtaagccggccctcgacgggtccctgactcgcttctcctggactccgaagtctacgggaccaacgaccggtccctcccgtcgaccgtctcgtcgggcctccgaggctgacggagtagacggtctagtattagtactgcaagggtcctagaattaggaggacgcgagaccgtaattaaggtttgggtcggttcggggaacgggtaagggacccgtaaaggccgttaacggcccgttacgttcgggttaccaacggaccccgtaaggccccgtaccggcccccgttcgggttaacccttaacccg

SEQ ID NO: 374708 - DNA, 562 bp, Homo sapiens
  misc_feature: GZ8MTXP01DKNQR.22.15.B04.1.454.CMB.2.raw
  modified_base (248)..(248): a, c, t, g, unknown or other
  modified_base (298)..(298): a, c, t, g, unknown or other
  modified_base (379)..(379): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctctggtaccaacaacaccaggacaaacgccccaaatcatgatttangaggtcactaagcgcctgacggggtcctgatcgcttctcctggctccaagtctaggacaacgacgccctccctgaccgtcncgtgggctcaggctggagatggaggctggtattacttaacgtgacaggtctcaatagtaggaggcaggaccgtaataagtttcgggagttcgggaacgggaagggacccaaaggcgtacggacccgttcgttaggttccgaacgaccccgaaggccgtccgcccccttcgggttcctaacccg

SEQ ID NO: 374709 - DNA, 570 bp, Homo sapiens
  misc_feature: GZ8MTXP01BNAPE.22.15.B04.1.454.CMB.2.raw
  modified_base (225)..(225): a, c, t, g, unknown or other
  modified_base (249)..(249): a, c, t, g, unknown or other
  modified_base (295)..(295): a, c, t, g, unknown or other
  modified_base (324)..(324): a, c, t, g, unknown or other
  modified_base (335)..(335): a, c, t, g, unknown or other
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttataactntgtctctgtaccacaacaccagacaaacgccccaaatcatgattangagtcacgtaagccgccctgacgggtccngactcgcttcncctggctcagtctaggcaacgcgccctcctcgacccgtctcgtcggctcgaggtctggaggatggaggtctagtacttatactgacaggctacatagtggagcaggacgtataaggtttgggtacggttcgggaacgggtaacgggttaccgaaggttcgtacggtacccgttacgttcggttacgaaccggacccgaaggtcccggtaccgttccccgttcggttcctaacccg

SEQ ID NO: 374710 - DNA, 594 bp, Homo sapiens
  misc_feature: GZ8MTXP01DF9MJ.22.15.B04.1.454.CMB.2.raw
  modified_base (224)..(224): a, c, t, g, unknown or other
  modified_base (296)..(296): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttaatactatgtctctgtaccaacacaccaggacaaacgccccaaatcatgatttangagtcactaagcgcctcgacgggtcctgactcgcttctcctggctcaagtctaggacaacgaccgccctccgtcgacccgtcgtcgtcgggctcgaggctggagatgaggtctagtattactactgacctaggctacaagttagagggacgcgagaccgtaagttaaggttttcgggtcggttcggggaacgggtaacgggaccgaaacggttcgtacggtacccgttccggttacggttccgaaccggtacccgaacggtccgtcccggttacccccgttcgggttcccttaacccg

SEQ ID NO: 374711 - DNA, 559 bp, Homo sapiens
  misc_feature: GZ8MTXP01DB7U1.22.15.B04.1.454.CMB.2.raw
  modified_base (222)..(222): a, c, t, g, unknown or other
  modified_base (246)..(246): a, c, t, g, unknown or other
  modified_base (251)..(251): a, c, t, g, unknown or other
  modified_base (293)..(293): a, c, t, g, unknown or other
  modified_base (369)..(369): a, c, t, g, unknown or other
  modified_base (410)..(410): a, c, t, g, unknown or other
tcagacatacgcgtcacgaccggtgctcgatttagacagtatatatccgcgggggggtctcaggaggcaacgctctcaggacgtcaccaccatggcctgggctctgctcctcctcagcctcctcactcagggcacagggtcctgggcccagtctgccctgactcagcctccctcgcgtccgggtctcctggacagtcagtcaccatctctgcactggaaccngcagtgacgttggtgttataactntgtcnctgtaccaacaacaccagcaaacgccccaaatcatgatttangagtcactagcgcctgacgggtcctgactcgcttctctcggctcaagtctggacaacgccggcctcctgacccgtncgtcggcctccagtctgagatggagtctagtattattacgngacagtcgtactagtagaggacgcgagtacgtaacgttagttgggtacggtcgggaggtaacgggtaacttaggtcgttacgtacccgtcgttacgttccgacgaacccgtacggtccgtcccgtccccgttcgtccgttaaccgtccg

SEQ ID NO: 374712 - DNA, 577 bp, Homo sapiens
  misc_feature: GZ8MTXP01BRVJ9.22.15.B04.1.454.CMB.2.raw
  modified_base (225)..(225): a, c, t, g, unknown or other
  modified_base (249)..(249): a, c, t, g, unknown or other
  modified_base (296)..(296): a, c, t, g, unknown or other
  modified_base (453)..(453): a, c, t, g, unknown or other
  modified_base (456)..(456): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccngcagtgacgttggtgttataactntgtctctgtaccaacacaccagacaaacgccccaaatcatgtattangagtcacgtaagccggcctcgacgggtcctgactcgtcttctccgtggctacagtctacggaccaacgccggtccctcccgtgtacccgttcgtcgtcgggcctcgaggtcgtggagtgtaggacgtctagtattatactgcaggtctacgattagnggngcgagcgtaagtagttgggtcgtcgggaaggacggttacaacgttcgtacggtacccgttacgttggttaccgaacggtccccgaaggtcccctccggttccccgtcggttccctaacccg

SEQ ID NO: 374713 - DNA, 558 bp, Homo sapiens
  misc_feature: GZ8MTXP01CBWLC.22.15.B04.1.454.CMB.2.raw
  modified_base (224)..(224): a, c, t, g, unknown or other
  modified_base (247)..(247): a, c, t, g, unknown or other
  modified_base (292)..(292): a, c, t, g, unknown or other
  modified_base (392)..(392): a, c, t, g, unknown or other
  modified_base (396)..(396): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttatactntgtctctgtaccaacacaccagacaacgccccaaatcatgattangagtcactaagcggcctcgacgggtcctgatcgcttctctggctcaagtctgacaacaccggccctccctgaccgtctcgtcgggcctcgaggctgaggngtgnggactgtacttatacgtgacaggtctacgtagtagtcggagcagaccgtattaagtttgggtcggttcgggaacgggtacgggacctaacgcgtacggtaccgttacgttcggttaccgaacgacccgaacgggccctccggccccgtcggttaaccctccg

SEQ ID NO: 374714 - DNA, 578 bp, Homo sapiens
  misc_feature: GZ8MTXP01E0IM1.22.15.B04.1.454.CMB.2.raw
  modified_base (300)..(300): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtgttacaagtatgtctctggtaccaacaccacccaggcacacgcccccaaatcatgatttangagtcactaagcgggcctcgagggggtccctgatcgctttcctctggctaccaagtctggcacaccggccctccctgaccgtctcgtgggcctccgagggctgaggatgagtctgattatactgacttactctatatgcaggccggtacaaaccgttgttggggtcgttcgggcgggaaggggacccaaagggcttacggaaccccgttccgttaacggggccaacggaccccgaaagggtccctccgcccccccgtttaacgggttccctaaccccg

SEQ ID NO: 374715 - DNA, 637 bp, Homo sapiens
  misc_feature: GZ8MTXP01BH7W3.22.15.B04.1.454.CMB.2.raw
  modified_base (225)..(225): a, c, t, g, unknown or other
  modified_base (304)..(304): a, c, t, g, unknown or other
  modified_base (389)..(389): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccngcagtgacgttggtagttataactatgtctcctggtaacccaacaacacccaggacaaacgcccccaaatcatgattangagtcactaagccggcctgacgggtccctgtactcgtcttctccgtcggctaccgaagtctacggaccaacgccggcccttcccncgtacccgtctcgtcgggctcccgagggtctggacggacgtaggacgggtctaggtaatttacgttaacccgttgtacccttacgtctaagtttaacgcgacgtacggccgtaacgaaccgttcgttcgggggttcgttcggggcggggaacggtaccgaaacggtcttccgggtaaccgtccgttacggttcgaaccgtcccggaaaggcccgttaccggtccccttccggtaaccgttcctttccg

SEQ ID NO: 374716 - DNA, 555 bp, Homo sapiens
  misc_feature: GZ8MTXP01BBLVO.22.15.B04.1.454.CMB.2.raw
  modified_base (224)..(224): a, c, t, g, unknown or other
  modified_base (294)..(294): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttatactatgtctctgtaccaacaacaccaggcaaacgccccaaatcatgattangagtcactaagcgccctcgacgggtcctgactcgcttctctggctacgagtctaggcaacgccggtcctcccgtgaccgtctcgtcgggctccaggctgaggtatgaggctgattatactgctaggctctaatacgtggagcgaggacgtaactaacggtttggtacggttcgggaacgggtaagggacctaaaggcgtacgtaccgttcgttacggttacaacgacccgtaaggcctaccgccccctggttcctaacccg

SEQ ID NO: 374717 - DNA, 623 bp, Homo sapiens
  misc_feature: GZ8MTXP01ARYZ2.22.15.B04.1.454.CMB.2.raw
  modified_base (470)..(470): a, c, t, g, unknown or other
  modified_base (600)..(600): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgtacgttggtggttaacaagtatgtctctggtaccaacaccaccagcacacgcccccaaactcatagtattatgagtcaacgtaagcggcctcgacgggggtccctagactcgtcttcctcgtcggctaccaacgtcgtcggccgacgacccgggccctcccgtcgacccgtcttcgcgggccttccgaggtctaggaggagtggaggtcgtagtatttaacttacgtcgtacttacctanaagttacgtcgccgaagggcccgaacctaaccggtcggtttacggggttcgggttccgggaacggggtaacggaccgtaaacggttcgtacggacccggttcgttacggttcaacggaccgaacggtccnccgttccccgtcggttaactccg

SEQ ID NO: 374718 - DNA, 625 bp, Homo sapiens
  misc_feature: GZ8MTXP01CLDCD.22.15.B04.1.454.CMB.2.raw
  modified_base (229)..(229): a, c, t, g, unknown or other
  modified_base (255)..(255): a, c, t, g, unknown or other
  modified_base (305)..(305): a, c, t, g, unknown or other
  modified_base (424)..(424): a, c, t, g, unknown or other
  modified_base (444)..(444): a, c, t, g, unknown or other
  modified_base (466)..(466): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacgagggtcctgggcccagtctgccctgactcacgccctccctccgcgtcccgggtctcctggacagtcagtcaccatctcctgcacgtggaaccngcagtgtacgttggtagttataactntgtctcgtagtaccaacacaccagacaaaccgccccaaatcatgtattangagtcaacgtaacgccgtccctagacgggtccctagactcgtcttctccgtcggctacgagtcgtacgacaaccgccgtccctcccgtcgaccgtctcgcgggctcgaggcgtgagtgngagtctagtatttactacgngactaggtctagtagttagggngggaacgccaggtaaccgtaacgttagggtttcgggtacgggttacggggaaccgggtaacggaccgtaacggttccgtaaccggtcccgttacgttacggcccggaacgtacccgaaggtcccctcccggttacccccgttcggttaaccttccccgg

SEQ ID NO: 374719 - DNA, 745 bp, Homo sapiens
  misc_feature: GZ8MTXP01BWLHD.22.15.B04.1.454.CMB.2.raw
tcagacatacgcgtcacgaccggtgctcgatttagacagtatatatccggcgggggggtctcaggaggcagcgctctcaggacgtcaccaccatggcctgggctctgctcctcctcagcctcctcactcagggcacgagggtcctgggcccagtctgccctgactcagccctcctccgcgtccgggtctcctggacagtcagtcaccatctcctgcactgaaccagcagtgacgttggtagttacaagttatgtctctaggtacccaacaccaccaggaccaacacgacccccaaaactcataggtaattttagacggacggttaccaaacgtttaaacgggcccgggtacccttacggacgggggttcccctagtacgtcgtcctttctcgtggcctacccgaagttcccgaggaaccgaccgtaaccgggcccttaccccgtagtaccccggtcttcgtacggggcctcccgaaggtccgttaggaacgggtacgttagggaacgggtccttaggtaaactttaagtttaacctcgggttacttaaacccgtttacgtaacgttacgtacggacggtacgggtaccggtaaccgttaacggtttcggggttacggggttccgggttacggggaacgggtaacgggttaaccgtaacggttaccgtaccggtaccgttacggttacggttaccgaaccggacccgtaacggtccgtcccggttaccccgttcgttccctaaccg

SEQ ID NO: 374720 - DNA, 640 bp, Homo sapiens
  misc_feature: GZ8MTXP01BGBRV.22.15.B04.1.454.CMB.2.raw
  modified_base (224)..(224): a, c, t, g, unknown or other
  modified_base (248)..(248): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttataactntgtctctgtaccacaacaccagcaacgccccaaatcatgattatgaggtcactaacgcgcctcgagggtcctgactcgcttctctggctcgagtcgtacgacaacgaccggccctcccgtcgaccgttctcgtcgggtctcccgaggtcctaggaggagttaggagggtccttaggtattacgttaacgtgtcacggggcttacgaagtacgtgggaaggcgaaggaccgttaagtaacggtttcgggttcgggttcggggaacgggtaacgggaaccgtaaacggttccgttaccggtaacccgggttaccgttacgggttcccgtaaccggaccccggtaaacgggtccccgttacccggccccccgttaacgggttcccttaacccccg

SEQ ID NO: 374721 - DNA, 620 bp, Homo sapiens
  misc_feature: GZ8MTXP01CZV4D.22.15.B04.1.454.CMB.2.raw
  modified_base (248)..(248): a, c, t, g, unknown or other
  modified_base (300)..(300): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctcctggtaccaacaacacccaggcaaacgcccccaaatcatgatttangagtcaactaagccggtccctcgacgggtccctgactcgtcttctccgtggctcgaagtccaggaccaacgaccggccctacctcggacccgtctacgtcgggacctcgacggtctaggaggtacgtggaacgggtccttagggtactttaacttacgttcgacgtaacgggtcttactaagttacgtagggacgtcgtaaggccgttaaataaggtttgggtacgttcggggaacggtacgggaacgtacgccgtaaacgggccgttacgttcggttcaacggcccgaaggtccctcggaccccgtggttcctaacccg

SEQ ID NO: 374722 - DNA, 698 bp, Homo sapiens
  misc_feature: GZ8MTXP01CY8TC.22.15.B04.1.454.CMB.2.raw
  modified_base (252)..(252): a, c, t, g, unknown or other
  modified_base (270)..(270): a, c, t, g, unknown or other
  modified_base (299)..(299): a, c, t, g, unknown or other
  modified_base (304)..(304): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagccctccctccgcgtccgggtctccgtggacagtcagtcaccatctcctgcactggaaccagcagtgacgttggtagttaataactntgtctcgtagtaaccaanaaccaccgagacaaacgccccaaatcatnattangagtcacgtaagccgcctgacgggtcctagacgtcgtcttcgtccgtggactacgtaagtcgtaacgggacccaaccgtcccggtcccttacccgtacggacccgttccgtcggtccgggtccttaccgacggtccgtaggaaccggtagtaggtaccgggttactaggtaactttaacgtactacgtaccttactacgtaagtagtacggacgacggtaccggtacgtaaaccgtttggttcgggggtttacggtaccggggacgggaaacgggtaaccgttaggtacccgttacggtaccccggttacgttaacgggttcccacccggaaccccggtaaccggtccccgttccccggtcccccgttacgggtcccttaacccgtttccccgg

SEQ ID NO: 374723 - DNA, 566 bp, Homo sapiens
  misc_feature: GZ8MTXP01BAD2E.22.15.B04.1.454.CMB.2.raw
  modified_base (225)..(225): a, c, t, g, unknown or other
  modified_base (411)..(411): a, c, t, g, unknown or other
tcagacatacgcgtcacgaccggtgctcgatttagacagtatatatccggcgggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctctgcactggaaccngcagtgacgttggtgttataactatgtctctggtaccaacaacaccagcaaacgccccaaatcatgtattatgagtcactaagcgcctcgacggggtcctgactcgcttctcctggctacgtaagtctacgggacaacgaccggccctcccgtcgacccgtctcgtcgggcctcgaggtctgaggnttcggagtctgattatactgccagggctacgaatagtgggaagcgaaggtcgactaaggtttggtacgttcgggaagggacggaacgtaagcgtacgtaccgttccgttaggttccaacggacccaacggtcctcgcccctcggttcctaacccg

SEQ ID NO: 374724 - DNA, 674 bp, Homo sapiens
  misc_feature: GZ8MTXP01CC50T.22.15.B04.1.454.CMB.2.raw
  modified_base (299)..(299): a, c, t, g, unknown or other
  modified_base (302)..(302): a, c, t, g, unknown or other
  modified_base (322)..(322): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgacccagcctgcctccgtgtctggatcatctggacagtcgatcagctatttcctgcactgggaccaacagtgactagttgggttctttgactctgtctctgtaccaacacaccacgaccaaccccccatcatctatttangtntcactcgtccgcctcgaggntctctcactcgcttctcaggctcaagtctgggaccaacaccggccctacccctaactactcgtccgtcgggtccttccgtaggttttacggaacggtacgtaacgttccttaacgtttacttacgtgtaccgttaagttttaaccctttaaaagtttaccggccgtacccctacgttccgtttacgggtttcgggttttaccgggcgggtacggtccgaacccggtaaacggttccggtacccggttcccgtacgggtccgaccggttcccccgttaacggggtccccttacccggcccccccggtttccggaccgttacccgtttcccgttccccggtttaaccccccccg

SEQ ID NO: 374725 - DNA, 566 bp, Homo sapiens
  misc_feature: GZ8MTXP01DTY85.22.15.B04.1.454.CMB.2.raw
  modified_base (301)..(301): a, c, t, g, unknown or other
  modified_base (342)..(342): a, c, t, g, unknown or other
tcagacatacgcgtcacgaccggtgctcgatttagacagtatatatccgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacagcacccaggacaaacgcccccaaatcatgatttangagtcactaagcggctcgacggggtccctgactcgcttccnctggctccaagtctggcgacacggccctaccctcgacccgtctcgtcgggcctccgagggctggaggatggaggctgaatttatacgtgacttactcaatacgtgactagggcgactacgttcgttgggtcggttcggaacgggaaggaccaaagttcgtacggacccgttacgttagggttaccaacgacccgaaggcctccgccccgtcggttaacctcccg

SEQ ID NO: 374726 - DNA, 674 bp, Homo sapiens
  misc_feature: GZ8MTXP01B7ZD2.22.15.B04.1.454.CMB.2.raw
  modified_base (224)..(224): a, c, t, g, unknown or other
  modified_base (249)..(249): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctccgtgcactggaaccngcagtgtacgttggtgttataactntgtctctagtaccaacaacaccagaccaaacgacccccaaactcatgtaatttagagtacgtcaacgtaacgccggcctcgacgggtccctgactcgtcttctccgtcggtctacgacgtcgtacgggaccaaccgcccgtccctccgtcgacccgtctcgtcggccctcgacggtcgtaggaggtagttacgggacggtcttaggtaactttagttacgtggtacctacggggtctacggtaagttagggtcggggaacgtaccgagggtacgtaacggttaggttttcgggggtacggttccgggggtaacgggaacggttaaccgtacggttccgtacggtaccccgttccgttacgggttccgaacccggacccgaacgggtccccgtaccggttcccccgttcggttcccgttaaccccg

SEQ ID NO: 374727 - DNA, 601 bp, Homo sapiens
  misc_feature: GZ8MTXP01DBBD0.22.15.B04.1.454.CMB.2.raw
  modified_base (249)..(249): a, c, t, g, unknown or other
  modified_base (265)..(265): a, c, t, g, unknown or other
  modified_base (271)..(271): a, c, t, g, unknown or other
  modified_base (341)..(341): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccagcagtgacgttggtgttaacagtntgtctctgtaccaacnccaccnggcacacgcccccaaatcatgtattatgagtcagtaagcggtcctcgacgggtccctgactcgtcttccnctggctaccagtcctggcgacacccgggtcccttaccgtgacccgttctccgtgggaccttcgaggccgtggaacgggtatggacggtctagtactttatactcggtaccttacttcaatagtgcgtaggtcggactacgtggttgggtcggttcgggaacgggtacggaccaggttccgtacggtcccgttacgttgggttaccctaacggacccgtaacgggtcctcccggttcccccgttaacgttccgttaacccg

SEQ ID NO: 374728 - DNA, 783 bp, Homo sapiens
  misc_feature: GZ8MTXP01A7FCG.22.15.B04.1.454.CMB.2.raw
  modified_base (218)..(218): a, c, t, g, unknown or other
  modified_base (301)..(301): a, c, t, g, unknown or other
tcagacatacgcgtcacgaccggtgctcgatttagacagtatatatccgcgggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctacgttttccngcacgtcgggaaccaacagtgactagtttgggtctttgactctgtctctagtacaacacaccacgacccaaccccactcactntattagtgtcgtcctacgtcgtccggccctagacggtactctctcactccgtccttcgtcacggtcctaccgtaaacgttccgtcggacccaaaccgtacccggtaccccttaccccgtaaccctacgttcccttaccgggtcggggtacccttaccggttaacgggtttacggaacgggtaaaccgggttactttaccttttaacgttaactttaaccgtcgttacgtttaacgtttaaccggttttaaacggtacggtacccgtccttacgttccggttcgggttcggttttaccgggggacggtacgggtacccgtaaccgggtacggttaaccggtaccccggttacccgttcgggttaaccgacccgggtaacccgttaaccggggttccccgttccccggttcccccgttacggggttaacccctacccgtttccccggttttccccgttaacccccgttccccctttaaccccgg

SEQ ID NO: 374729 - DNA, 624 bp, Homo sapiens
  misc_feature: GZ8MTXP01DAIIP.22.15.B04.1.454.CMB.2.raw
  modified_base (264)..(264): a, c, t, g, unknown or other
  modified_base (284)..(284): a, c, t, g, unknown or other
  modified_base (294)..(294): a, c, t, g, unknown or other
  modified_base (348)..(348): a, c, t, g, unknown or other
  modified_base (369)..(369): a, c, t, g, unknown or other
  modified_base (405)..(405): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgtttggtgttataactatgtctctgtaccaanacaccagcaaagccccaaancatgatttangagtcactaagcgccctcgacggggtcctgatcgcttctccccggctcaagtcncggaccaacgcggccctcccncgaccagtctcgtcggacctcgaggtctgaaccgtntaggtagggtctacttttactactcggtctaccgtagtaacttacgtacgtacgaacgtaacctaaattaagttaaagttggttccgttacggtaccgggacgggtaaaccgaaacggttacggtaaccgttacccggttaggttaccgaacgttcccgaaccggaacgttcccgccccgttacccggtcgttacgttaacccttccgtttaacccccg

SEQ ID NO: 374730 - DNA, 686 bp, Homo sapiens
  misc_feature: GZ8MTXP01DIM6D.22.15.B04.1.454.CMB.2.raw
  modified_base (226)..(226): a, c, t, g, unknown or other
  modified_base (291)..(291): a, c, t, g, unknown or other
  modified_base (295)..(295): a, c, t, g, unknown or other
  modified_base (301)..(301): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcacgcctccctccgcgtccgggtctcctggacagtcagtcaccatctcctgcactaggaaccngcagtgtacgttggtgttaataacttatgtctctagtaccaacacaccagacaaacaccccaaancatntattangagtcactaacgccgcctcgacgggtcctagactcgtcttctccgtcggactcgtaagtcgtaacgacaaccgaccgtccctcccgtacgtaccgtctcgtcgggcctcgaggctaggacggatcggagtcgtagttattactacgtacgacaggtccttagtaagttacggaggacgctaacggtaaccgtaacgtttagggtttcgggtacggggttccggggaacgggtaacgggttaaaccgtaacggttcccgttaaacccggggtccccggttttaacggttacggggttaccccaacccgggttaaaacccccggcgggttcccccggttccccgggttaccccccgggtttaacgttaacccccgtttaaccccggg

SEQ ID NO: 374731 - DNA, 529 bp, Homo sapiens
  misc_feature: GZ8MTXP02J1Z28.22.15.B04.1.454.CMB.2.raw
  modified_base (211)..(211): a, c, t, g, unknown or other
  modified_base (223)..(223): a, c, t, g, unknown or other
  modified_base (247)..(247): a, c, t, g, unknown or other
  modified_base (298)..(298): a, c, t, g, unknown or other
  modified_base (353)..(353): a, c, t, g, unknown or other
  modified_base (428)..(428): a, c, t, g, unknown or other
  modified_base (456)..(456): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctccngcactggaaccngcagtgacgttggtgttataactntgtctctggtaccaacaacaccaggcaaacgcccccaaactcatgatttangagtcactaagcgccctgacggggtccctgactcgcttctcctggctccaagtcnggcacgacggccctccctgacccgtctcgtcgggcctccgaggctggaggatggagctgtattatactgcagctnatacgtggagcagcgactaagtttgggngttcggcggaggaccaagctcgaccgtcgtaagtccaacgcccgaacggcctaccgccccctcggtcctaccg

SEQ ID NO: 374732 - DNA, 521 bp, Homo sapiens
  misc_feature: GZ8MTXP02FWX9J.22.15.B04.1.454.CMB.2.raw
  modified_base (298)..(298): a, c, t, g, unknown or other
  modified_base (449)..(449): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacaacaccaggcaaacgcccccaaactcatgatttangaggtcactaagcggccctcgacggggtccctgatcgcttctcctggctcaagtctggcacacggcctcctcgaccgtctctcgggcctccgaggctggaggatgagctgtattatactgcagctcatatggagcagcgactaagtttggngttcggacggagggaccaagcgtacgaccgtctaggtacaacgcccgaaggcctccgccccgtcggctaccg

SEQ ID NO: 374733 - DNA, 545 bp, Homo sapiens
  misc_feature: GZ8MTXP02GV85Z.22.15.B04.1.454.CMB.2.raw
  modified_base (298)..(298): a, c, t, g, unknown or other
  modified_base (337)..(337): a, c, t, g, unknown or other
tcagacatacgcgtcacgaccggtgctcgatttagacagtatatatccgcgggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaatcatgatttangagtcactaagcggcctcgaggggtccctgatcgcttcncctgctcagtctggcacaccggcctccctgacccgtctcgtcgggctccaggctggagatgaggctgattatactgcagctcatagtggagcagcgaactaagtttgggtagttcgggcggaggggtaccaaaggtcgtacggacccgttcgtaaggtccaacggaccccaaaggggcctccggccccccgttacgggtcctaacccg

SEQ ID NO: 374734 - DNA, 528 bp, Homo sapiens
  misc_feature: GZ8MTXP02HEADQ.22.15.B04.1.454.CMB.2.raw
  modified_base (336)..(336): a, c, t, g, unknown or other
  modified_base (340)..(340): a, c, t, g, unknown or other
  modified_base (377)..(377): a, c, t, g, unknown or other
  modified_base (411)..(412): a, c, t, g, unknown or other
  modified_base (415)..(415): a, c, t, g, unknown or other
  modified_base (417)..(417): a, c, t, g, unknown or other
  modified_base (426)..(426): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctcctgtaccaaacaacacccaggcaaaacgcccccaaatcatgatttatgaggtcactaagcggccctgaggggtccctgatcgnttcncctgctccaagtctggcacacgcctccctgaccgtcnctgggctccaggctgagatgagctgattattacnncantnatagagagngagacgacgtaagttagtggtcggtacgggacggaacgaacgacgtacgtaccgtaccgtacgtacgaacgaccgaacgacgtccgcccgtccgtacctacg

SEQ ID NO: 374735 - DNA, 553 bp, Homo sapiens
  misc_feature: GZ8MTXP02F4O1Y.22.15.B04.1.454.CMB.2.raw
  modified_base (248)..(248): a, c, t, g, unknown or other
  modified_base (298)..(298): a, c, t, g, unknown or other
  modified_base (337)..(337): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctctggtaccaacaacaccaggcaaacgccccaaactcatgatttangagtcactaagcgccctcgaggggtccctgatcgcttcncctggctcaagtctggcacgaccggcctcctgaccgtctctcgggctccgaggctgaggatggaggtctagatttattactggtccagctcatagtgggagcgagacgactaagtttgggtggttcggacgggtacgggaccgaacggtcgtacggacccgttacgtaggtccgaacgcccgaaacggtccgtaccgcccccgtcggtcctacccg

SEQ ID NO: 374736 - DNA, 510 bp, Homo sapiens
  misc_feature: GZ8MTXP02HB8XD.22.15.B04.1.454.CMB.2.raw
  modified_base (241)..(241): a, c, t, g, unknown or other
  modified_base (357)..(357): a, c, t, g, unknown or other
  modified_base (424)..(424): a, c, t, g, unknown or other
  modified_base (428)..(428): a, c, t, g, unknown or other
  modified_base (447)..(447): a, c, t, g, unknown or other
tcagacatacgcgtcacgaccggtgctcgatttagacagtatatatccgcgggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttanaactatgtctctggtaccaacaacaccaggcaaagcccccaaatcatgatttatgaggtcaactaagcggcctcgaggggtccctgatcgcttctcctgctccaagtctggcaccncggcctccctgacccgtctcgtcgggcctccgaggctggagatcgaggctgattagtactgcagctnatgngagcagcgataagtttggngtcggacggagggacctagctgaccgtctaggtcaagcccgaagctcgcccccgtggtctacc

SEQ ID NO: 374737 - DNA, 499 bp, Homo sapiens
  misc_feature: GZ8MTXP02I17US.22.15.B04.1.454.CMB.2.raw
  modified_base (244)..(244): a, c, t, g, unknown or other
  modified_base (261)..(261): a, c, t, g, unknown or other
  modified_base (350)..(350): a, c, t, g, unknown or other
  modified_base (368)..(368): a, c, t, g, unknown or other
  modified_base (482)..(482): a, c, t, g, unknown or other
tcagacatacgcgtcacgaccggtgctcgatttagacagtatatatccgcgggggtctcaggaggcagcgctctcaggacgtcaccaccatggcctgggctctgctcctcctcagcctcctcactcagggcacagggtcctgggcccagtctgccctgactcagcctcctccgcgtccggtctcctggacagtcagtcaccatctcctgcactggaaccagcagtgacgttggtgttataactntgtctcctggtaccaanaacaccaggcaaacgccccaaactcatgattatgagtcactaagcggcctcgagggtccctgatcgcttctcctgctcagtctggcacncggcctccctgacccgtntcgtggctcaggctgagatgaggctgattatactgcagctcatagtgaggcagcgaactagtttggtgttcggcggaggaccagctcgaccgtcgtaggtcaacgcccaaggcncgcccctcggtctaccg

SEQ ID NO: 374738 - DNA, 548 bp, Homo sapiens
  misc_feature: GZ8MTXP02IETHN.22.15.B04.1.454.CMB.2.raw
  modified_base (224)..(224): a, c, t, g, unknown or other
  modified_base (248)..(248): a, c, t, g, unknown or other
  modified_base (301)..(301): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagccctcctcactcagggcacagggtcctgggcccagtctgccctgactcagcctccctccgcgtccgggtctcctggacagtcagtcaccatctcctgcactggaaccngcagtgacgttggtgttataactntgtctcctggtaccaacaacacccaggacaaacgcccccaaatcatgatttangagtcataagcgccctgagggtccctgatcgcttctcctggcctccaagtctaggacaccgcggccctccctagacccgtctcgtcgggcctccgaggtctgacggatggagctagattatacgtgcagtctacatagtggagcagcgtactaagtttggacgttcggcggtaggaccgaacgtcgtacgaccgtaccgtaggtccgaacgcccgaacggcctaccgtcccccgtcggtacctaccg

SEQ ID NO: 374739 - DNA, 520 bp, Homo sapiens
  misc_feature: GZ8MTXP02IPPZ7.22.15.B04.1.454.CMB.2.raw
  modified_base (249)..(249): a, c, t, g, unknown or other
  modified_base (296)..(296): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagccctcctcactcagggcacagggtcctgggcccagtctgccctgactcagccctccctccgcgtccgggtctcctggacagtcagtcaccatctcctgcactggaaccagcagtgacgttggtgttacaagtntgtctctgaccaacaccaccagcacacgcccccaaatcatgatttangagtcataagcggcctcgagggtccctgatcgctttcctctcggctccaagtcctggcgacacggccctcccgtgacccgtctcgtcgggctccgagctgagatgagctgtattattactgtactactcatatgcaggcgactaacgttcgttgggtgttcggcggacggaccagcgtacgaccgtcgtagcaacgccgaaggcctcgccccgtcggtctaccg

SEQ ID NO: 374740 - DNA, 541 bp, Homo sapiens
  misc_feature: GZ8MTXP02H7NM9.22.15.B04.1.454.CMB.2.raw
  modified_base (246)..(246): a, c, t, g, unknown or other
  modified_base (296)..(296): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctctgcactggaaccagcagtgacgttggtgttataactntgtctctgtaccaacaacacccaggcaaacgcccccaaatcatgatttangagtcataagcggccctgacggggtccctgactcgcttctccgtgcctacaagtctggaccacgaccggtcctccccgtgacccgttctcgtcggccctccgagcgtgaggatggaggctagtatttactactgctagctactagtagtggagacgagccgtaacttagttggtcgttcggaggtacggacgaacgcgtacgaccgtcgtagcaacgccgaacggcctcgcccccgtgtacctcg

SEQ ID NO: 374741 - DNA, 528 bp, Homo sapiens
  misc_feature: GZ8MTXP02G1840.22.15.B04.1.454.CMB.2.raw
  modified_base (299)..(299): a, c, t, g, unknown or other
  modified_base (426)..(426): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcatccgggtctcctggacagtcagtcaccatctcctgcactggaaccagcagtgacgttggtgttataactatgtctctggtaccaacaacacccaggcaaacgcccccaaatcatgatttangagtcactaagcggccctgaggggtccctgatcgcttcctctggctccagtctggccaacacggcctccctgaccgtctcgtgggctccaggctggagatgagctgattatactgcagctcattagnggagcagacgtatagtttggtcggttcgggacggacggaccaggtcgtacggacccgtcgtaggccgacgacccgaacggtcctcccggtccccgtcggtcc

SEQ ID NO: 374742 - DNA, 648 bp, Homo sapiens
  misc_feature: GZ8MTXP02IFWF1.22.15.B04.1.454.CMB.2.raw
  modified_base (393)..(393): a, c, t, g, unknown or other
  modified_base (439)..(439): a, c, t, g, unknown or other
tcagacatacgcgtcacgaccggtgctcgatttagacagtatatatccgcgggggggtctcaggaggcagcgctctcaggacgtcaccaccatggcctgggctctgcctcctcctcagccctcctcactcagggcacagggtcctgggcccagtctgccctgactcagcctccctccgcgtccgggtctcctggacagtcagtcaccatctcctgcactggaaccagcagtgacgttgatggttataactatgtctctgtaccaaacacacccaggacaaacgcccccaaatcatcgatttatgaggtcactaagcggccctcgacgggtccctgactcgcttctctgctaccagtcgtggccaaacgcggtccctccctgacccgtcttcgngggacctccgagcctaggagagtcggaggctagtatttagttacgngtaccagtcctataattgacggggaggacctagggacctaaagtaaagttttggggtacggtttccgggggacggggttacggggaaacccaaaaggggtcccgttacggtaaacccccggggtttcctaaacggggttaacccgaaccggaccccgtaaaacggggtcccgttacccccggtaccccccggtttacgggttacccccg

SEQ ID NO: 374743 - DNA, 518 bp, Homo sapiens
  misc_feature: GZ8MTXP02GMBM0.22.15.B04.1.454.CMB.2.raw
  modified_base (247)..(247): a, c, t, g, unknown or other
  modified_base (295)..(295): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctctggtaccaacacaccaggcaaagcccccaaatcatgatttangagtcataagcgccctcgaggggtccctgatcgcttctcctgctccaagtctggcacacggcctccctgacccgtctctgggcctccgaggctgaggatgaggctgattatctgcagctcatagtggagcagcgaactaatttgggtgttcgggacggacgggaccaaggcgtacgaccgtcctaggtccaacgcccaaggcctacgccccgttcggctaccg

SEQ ID NO: 374744 - DNA, 565 bp, Homo sapiens
  misc_feature: GZ8MTXP02FVAFI.22.15.B04.1.454.CMB.2.raw
  modified_base (297)..(297): a, c, t, g, unknown or other
  modified_base (404)..(404): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaacaacaccaggcaaacgcccccaaatcatgatttangaggtcactaagcggcctcgacggggtccctgatcgcttctcctggcctccaagtctggcgacaccggccctcctgacccgttctcgtgggctccgaggcgtgaggntgaggctgatttatactgtactactcattatcgcgtaacggcgacaacgttcgttggggttgttccggggacgggacgggaccaaaggtcgtacggtacccgtcgttaacgggctacggaacccgaagtccgtccggcccccgttcggacctacgttcccg

SEQ ID NO: 374745 - DNA, 578 bp, Homo sapiens
  misc_feature: GZ8MTXP02I92RU.22.15.B04.1.454.CMB.2.raw
  modified_base (247)..(247): a, c, t, g, unknown or other
  modified_base (398)..(398): a, c, t, g, unknown or other
  modified_base (410)..(410): a, c, t, g, unknown or other
  modified_base (456)..(456): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctctgtaccaacaacaccagacaaacgaccccaaactcatgtattatgtgtcactcgtccgcctcgagtagtctctctatcgtccttctcgtcgctcaagttctggacaacgccgtccctcctacgaccctctccgtcggcctaccgnggtcctggagtntggacggtctagtaactttagttactgtacgtagctacagttaggnggacgcgtacgacgtacgtagtttcggtacggttacggacgggaacggaccgtacggtcgtacggtacccgtacggtaacggtaccgaccggacccgtacggtccgtcccgtccccgtacgg

SEQ ID NO: 374746 - DNA, 571 bp, Homo sapiens
  misc_feature: GZ8MTXP02HT0M9.22.15.B04.1.454.CMB.2.raw
  modified_base (248)..(248): a, c, t, g, unknown or other
  modified_base (264)..(264): a, c, t, g, unknown or other
  modified_base (299)..(299): a, c, t, g, unknown or other
  modified_base (455)..(455): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctcctgtaccaanagcacccaggcaaacgcccccaaatcatgatttangaggtcaacgtaagccggccctcgacggggtccctgatccgcttcctctggctccaagtctggccaacgacggccctcccctgacccgtctcgtacgggcctcccgaggctggaggtactggaggctagatttattactgacagtcttacattagnggagcagcgaatagtttggcggttcgggacggtagggaccaaggcctacggacccgttaccgaggtcccaacggacccccgtaaagggcccttcccggaccccccgtttacggccc

SEQ ID NO: 374747 - DNA, 602 bp, Homo sapiens
  misc_feature: GZ8MTXP02HSNSI.22.15.B04.1.454.CMB.2.raw
  modified_base (298)..(298): a, c, t, g, unknown or other
  modified_base (352)..(352): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctcctggtaccaacacacccaggcaaacgcccccaaatcatgatttangagtcactaagccggcctgacgggtcctgactcgcttctcctgacctcaagtcnggcacgccggcctccctgaccgtctcgcgggtcctcccgaggcgtccccggaggtacgtgggacggtcgtagtatttaacttaccgtgtacgtaagcttacagttagcggaggacaacggcgtaacttaagtttagggtacgttcggggacgggtaacggggaccgaaacggtccgtaccggtaccggttaccgtacggtaccgaacgaccccgaacggcccttccggccccccgttcggtacctacccg

SEQ ID NO: 374748 - DNA, 621 bp, Homo sapiens
  misc_feature: GZ8MTXP02H6GX2.22.15.B04.1.454.CMB.2.raw
  modified_base (225)..(225): a, c, t, g, unknown or other
  modified_base (301)..(301): a, c, t, g, unknown or other
  modified_base (334)..(334): a, c, t, g, unknown or other
  modified_base (406)..(406): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcacgcctccctccgcgtccgggtctcctggacagtcagtcaccatctctgcactggaaaccngcagtgacgttggtagttacaagtatgtctccgtgaccaacaccaccagcacacgacccccaaatcatgtatttangaggtacaacgtaaggcggcctgacgggtcccngactcgcttctctggcctccaagtcgtggccaacgaccggccctcccgtcgacccgtctcgtcgcctaccgnggctggagagtggacgggtctaaggtatttaactacgtcgtacttacctactaattacgtcgacggacgggtacggaccttaacgttcgtttacgggggtggttaccgggacgggaacggggacaaacggtccgtaccggtacccgtacccgttaaggtcccgaaccgccccgaaacggtccgttccccggacccccgttacggttcctacccgg

SEQ ID NO: 374749 - DNA, 604 bp, Homo sapiens
  misc_feature: GZ8MTXP02IITHR.22.15.B04.1.454.CMB.2.raw
  modified_base (247)..(247): a, c, t, g, unknown or other
  modified_base (447)..(447): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgtataactntgtctctgacaacaacaccagacaaacgaccccaaatcatataatttatgagtacaacgtaagccgcctacgacgggtccctgactcgcttctccgtcgctacagtctggacacgccgccctcccgtcgacccgtctcgtcggcctacgacggtcgtggagagtggacgtctagtattacgttacgtagtacgagtctanatagtggagacgagacgtaagttaagtttgggtacggttcggggaacgggtaacggggaaccgaaacggttaccgtacggtacccggttaccgtttacggtaccgaacggtacccgaaaacggtccgtaccccgtccccgttccggtacttacccgg

SEQ ID NO: 374750 - DNA, 679 bp, Homo sapiens
  misc_feature: GZ8MTXP02JJK92.22.15.B04.1.454.CMB.2.raw
  modified_base (248)..(248): a, c, t, g, unknown or other
  modified_base (293)..(293): a, c, t, g, unknown or other
tcagacatacgcgtcacgaccggtgctcgatttagacagtatatatccgcgggggggtctcaggaggcaacgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctctgtaccacacaccagacaaacgccccaatcatgatttangagtcactagcgcctcgacgggtcctgatcgcttctcgtcgctccgagtctcggacaacgccggtccctcccgtggtaccccgtctcgtcggggtccctacccgtacgggtcctagggaacgggtagtcggggtaacggtccgttaggttaactttttaacgttaccgtgtaccgtacggttccttacgtaaggtttaaggtcgggggaaacgcccgtaaacgggtaccggtaaacgtttaagggttttcggggttacggttaccgggggacgggtaaacggggaccctaaacgggtccggttacggaccccggttaccgtaacggtaccgaccggaacccgtaacggtcccgtcccggtcccccgtacggtccctaccgttcccg

SEQ ID NO: 374751 - DNA, 587 bp, Homo sapiens
  misc_feature: GZ8MTXP02J418Q.22.15.B04.1.454.CMB.2.raw
  modified_base (292)..(292): a, c, t, g, unknown or other
  modified_base (366)..(366): a, c, t, g, unknown or other
  modified_base (413)..(413): a, c, t, g, unknown or other
tcagacatacgcgtcacgaccggtgctcgatttagacagtatatatccggcgggggttctcaggaggcagcgctctcaggacgtcaccaccatggcctgggctctgctcctcctcagcctcctcactcagggcacagggtcctgggcccagtctgccctgactcagcctccctccgcgtccggttctcctggacagtcagtcaccatctcctgcactggaaccagcagtgacgttggtgttatacatgtctctgtccaacaacaccacgcaagccccaactccatgattatntggtcactacaacggcccgtaccctagggtccgttcgacttcgcttctcctcgtctccaaagtcctagggttcncaaccggccgtccccctgaacccgtctcctcgtcgtccgaacgcggngaggagtgagtcgtagtattagttacttgtactacgtctctactacgtagtagacgtagacgacgtacgtacgtacgtacggttacggttacggtacgtacggtacggtacgtacgtacgtacgtaccgtaaccgtacgtaccgtaccgtaccgtaccgtaccgtaccgtaccg

SEQ ID NO: 374752 - DNA, 568 bp, Homo sapiens
  misc_feature: GZ8MTXP02I781Y.22.15.B04.1.454.CMB.2.raw
  modified_base (247)..(247): a, c, t, g, unknown or other
  modified_base (299)..(299): a, c, t, g, unknown or other
  modified_base (381)..(381): a, c, t, g, unknown or other
  modified_base (404)..(404): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctcctggtaccaacaacaccaggacaaacgccccaaatcatgtatttangagtcactaagcggcctcgaggggtccctgatcgcttctctggcctccaagtctggacaccgacgccctccctgacccgtcncgtcggctccgagctgagagtgnggctgtattatactgcagctcatagtggacgcgagcgaacgtagtttgggtcggttcgggacgggacgggtaccgaacggtaccgtacggtacccgttaccgtacggtaccgaacgaccccgaacggtcccgttaccgtccccccgttacgggtcccttacccg

SEQ ID NO: 374753 - DNA, 567 bp, Homo sapiens
  misc_feature: GZ8MTXP02FTTAO.22.15.B04.1.454.CMB.2.raw
  modified_base (246)..(246): a, c, t, g, unknown or other
  modified_base (293)..(293): a, c, t, g, unknown or other
  modified_base (330)..(330): a, c, t, g, unknown or other
  modified_base (342)..(342): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctcgcgtccggtctcctggacagtcagtcaccatctcctgcactggaaccagcagtgacgttggtggttataactntgtctctgtaccaacaacaccaggcaaagcccccaaatcatgattangagtcataagcgcctcacggggtccctgatcgcttcnctggctcagtcnggcacacggcctcctgaccgtctcgtgggcctcgaggctgaggatggaggctagtattactactgcagctacatagtaggagcacggcggtaaactagtttgggtcggttcgggacgggaacggggaccaaacgggtccgttacggtaccccgttaccgtacgggttaccaacggacccccgaaaagggtccctacccggtaccccccgtcgggttacctacccg

SEQ ID NO: 374754 - DNA, 587 bp, Homo sapiens
  misc_feature: GZ8MTXP02GJLAA.22.15.B04.1.454.CMB.2.raw
  modified_base (264)..(264): a, c, t, g, unknown or other
  modified_base (300)..(300): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactatgtctctggtaccaanagcaccaggacaaacgcccccagactcatcatttangctgtacaataagcggccctcgacggggtccctggactccgtcttctctcggtcctccaagtcgtaggaccaaacgaccggccctcccgtcgaaccctactccgttctcggggcctaccgagggtcctaggaagagtggaggtctagtaatttactttaactgtactcgtcttacctagtttcgacgacggccgtacctaacgtcgttggggttcgttcgggacgggtacggacaacgtcgtcggaccgtccgttacgacgacgaccgaacggccgtacgtcccccg

SEQ ID NO: 374755 - DNA, 619 bp, Homo sapiens
  misc_feature: GZ8MTXP02IZ881.22.15.B04.1.454.CMB.2.raw
  modified_base (247)..(247): a, c, t, g, unknown or other
  modified_base (293)..(293): a, c, t, g, unknown or other
  modified_base (321)..(321): a, c, t, g, unknown or other
  modified_base (331)..(331): a, c, t, g, unknown or other
  modified_base (343)..(343): a, c, t, g, unknown or other
  modified_base (425)..(425): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtgttataactntgtctctgtacacacaccaggacaaacgccccaaatcatgatttangagtacagtagcgacctcgagggtcccngatcgcttcnctgctcaagtcnggacacgcgtcctccgtgcccgtctcgtcgggactccgaggtctagacggagtggacggtctagttaacttacgtttaacgngacgtacgtcttactaggtagacgggacggaccgaaggtaccgtaacgttaagggtttcgggtacgggttaccggggaacgggaaacgggtaaccgtaaacgggtccgttaaccgggtaccccgtaccggtaacgggtccgaacccggtacccggaacggtcccgtccccgtcccccgtacggttacctacccg

SEQ ID NO: 374756 - DNA, 697 bp, Homo sapiens
  misc_feature: GZ8MTXP02G8VTA.22.15.B04.1.454.CMB.2.raw
  modified_base (224)..(224): a, c, t, g, unknown or other
  modified_base (247)..(247): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttatactntgtctctgacacacaccagacaacgaccccaatcatgtattatgagtcaacgtaacgcgccctacgacgggtccctgactcgtcttctccgtcgacctacctaagtccgtaggaccaccgtaccggcccttcccgtccgaccgttctcgtcgggcctcgaggtccgtaggacggtagttcggaacgtcgtaggttaaattttacgtaccgttacggacgtaaacggttccctaagtaagtacgggttacgggaacggtacgtaacggaccggtaaacgtttaaaggtttcggggtttacgggttaccgggggaaccggggtaaacgggggtaacctaaaccggggtccggttaaaccggtaccccggttaaccgttacgggacccgaacccggtcccggaaaccggtccccgtacccgggtccccccgttcgggtaacccctttccccgg

SEQ ID NO: 374757 - DNA, 662 bp, Homo sapiens
  misc_feature: GZ8MTXP02GA5EU.22.15.B04.1.454.CMB.2.raw
  modified_base (224)..(224): a, c, t, g, unknown or other
  modified_base (248)..(248): a, c, t, g, unknown or other
  modified_base (307)..(307): a, c, t, g, unknown or other
  modified_base (355)..(355): a, c, t, g, unknown or other
  modified_base (497)..(497): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcacatcctcctgcactcggaaccngcagtgacgttggtgttataactntgtctctgtaaccaacaaccaccgaggaccaaacgacccccaaactcaatgtaatttangacggtacacgtaagccggtccctagacgggtcctgactcgtctttcnccgtgtcctacgaagttctcggactaccgccggtccctacccgtgtacccgttctccggtcggggtccctaccggacggtccgtagggaggacgttggacggtctaggtattactttacgagtacaggtcctatagttaggnggacggacgacggaccgtaattaggtttacgggtcgggttaccggggaacgggacgggaaccgtaaacggtaccgttacggtaaccccggttaccgtaccggggtacaaccggaacccggaaacggtcccgtcccccggtaccccgttccgggtcttaaccccgg

SEQ ID NO: 374758 - DNA, 627 bp, Homo sapiens
  misc_feature: GZ8MTXP02JAPF7.22.15.B04.1.454.CMB.2.raw
  modified_base (226)..(226): a, c, t, g, unknown or other
  modified_base (245)..(245): a, c, t, g, unknown or other
  modified_base (250)..(250): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatcctcctgcactggaaccngcagtgacgttggtgttanaactntgtctctgtaccaacaacaccagacaaacgccccaaatcatgtattatgacgtacacgtaacgccggccctcggagggtccctgatccgtcttctcctgcctacaagtctgaccacgccgtaccctcccgtcgtacccgtctccggtcggtacctccgaggcctaggaggagtggacgtctagtattactacgtggactagtcctagtattaggagggacgacgtaacggtacgtacgttaaggttttcggggtacggttacgggacggggtacgggtaaccgacggtacgtaccgggtacccgtaccggttacggaacccgaacgaacccccggtacggtacccgttcccgacccccggtccggttacctaacccg

SEQ ID NO: 374759 - DNA, 537 bp, Homo sapiens
  misc_feature: GZ8MTXP02H90DG.22.15.B04.1.454.CMB.2.raw
  modified_base (244)..(244): a, c, t, g, unknown or other
  modified_base (250)..(250): a, c, t, g, unknown or other
  modified_base (283)..(283): a, c, t, g, unknown or other
  modified_base (288)..(288): a, c, t, g, unknown or other
  modified_base (311)..(311): a, c, t, g, unknown or other
  modified_base (320)..(320): a, c, t, g, unknown or other
  modified_base (322)..(322): a, c, t, g, unknown or other
  modified_base (330)..(330): a, c, t, g, unknown or other
  modified_base (335)..(335): a, c, t, g, unknown or other
  modified_base (342)..(342): a, c, t, g, unknown or other
  modified_base (347)..(347): a, c, t, g, unknown or other
  modified_base (350)..(350): a, c, t, g, unknown or other
  modified_base (358)..(358): a, c, t, g, unknown or other
  modified_base (379)..(379): a, c, t, g, unknown or other
  modified_base (384)..(384): a, c, t, g, unknown or other
  modified_base (390)..(390): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacaggtcctgggcccagtctgccctgactcagcctccctccgcgtccgggtctcctggacagtcagtcaccatctcctgcactggaaccagcagtgacgtggtgtataactntgctcngaccaacacaccaggcaaacgccccaaatcatnattangagtcatagcgcctgacggtccngatcgctcncngctcagtngcacncgctccngcctntcnggcctcgngctgagagtgagtcagtattnttacngcagtntacgattaggaggacgacaggaccgtagttaagtttgggtagttacgggtacggaacggggacaaacgtcgacggaaccgttcccgtaggtaccgaaccggacccaagggtcctacccggtacccccgttaggtaacccctttcccg

SEQ ID NO: 374760 - DNA, 589 bp, Homo sapiens
  misc_feature: GZ8MTXP02GBDVS.22.15.B04.1.454.CMB.2.raw
  modified_base (224)..(224): a, c, t, g, unknown or other
  modified_base (248)..(248): a, c, t, g, unknown or other
  modified_base (298)..(298): a, c, t, g, unknown or other
  modified_base (304)..(304): a, c, t, g, unknown or other
  modified_base (331)..(331): a, c, t, g, unknown or other
  modified_base (345)..(345): a, c, t, g, unknown or other
tcagacatacgcgtcacgaccggtgctcgatttagacagtatatatccgcgggggtgtctcaggaggcagcgctctcaggacgtcaccaccatggcctgggctctgctcctcctcagcctcctcactcagggcacagggtcctgggcccagtctgccctgactcagccctccctccgcgtccggtctcctggacagtcagtcaccatctcctgcactggaaccngcagtgacgttggtgttataactntagtctctaggtaccaaacaaccacccagacaaacgcccccaaactcatnatttangagtcataacgcgcctcgacgggtccngatcgtcttcctcngctcagtctgcacacggcctcccgtgaccgtctcgtcggctcccgagctggagatggaggctagtattattacgtcgacgtagtcctagtagttagtagggacgtacgacggtacgacgttaagtttggggtacggttacggggacgggtaacgggaaccgtaaaggtccgtacgtacccgttcggtaacggtccgaaccggacccgtaacggtcccgtacccgtacccccgtcggttaacccg

SEQ ID NO: 374761 - DNA, 609 bp, Homo sapiens
  misc_feature: GZ8MTXP02JQJC4.22.15.B04.1.454.CMB.2.raw
  modified_base (206)..(206): a, c, t, g, unknown or other
  modified_base (223)..(223): a, c, t, g, unknown or other
  modified_base (246)..(246): a, c, t, g, unknown or other
  modified_base (297)..(297): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccntctcctgcactgaaccngcagtgacgttggtgttatactntgtctctggtaccaacaacaccaggacaaacgccccaaactcatgatttangagtcaactaagccgcctcgacgggtcctgatcgtcttctcctggcctcagtctggacacgaccggcctccgtcgaccgtctcgtcgggtcctccgaggtctggaggtatggacggtcttagtaatttacgttactgctaagtcctagaagttacggtagggacggacctaagggtacccgtaaacgtttaaaggtttcgggtacgggttaccgggacggggtaacggtaaccgaacggtcgtaaccggtaccgtacggacgtaccgaacggacccgtaacggccgtccccgtcccgtacggtcctaccccg

SEQ ID NO: 374762 - DNA, 554 bp, Homo sapiens
  misc_feature: GZ8MTXP02IO5AW.22.15.B04.1.454.CMB.2.raw
  modified_base (246)..(246): a, c, t, g, unknown or other
  modified_base (327)..(327): a, c, t, g, unknown or other
  modified_base (439)..(439): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagccctcctcactcagggcacagggtcctgggcccagtctgccctgactcagcctccctccgcgtccggtctcctggacagtcagtcaccatctcctgcactggaaccagcagtgacgttggtgtataactntgtctctgtaccacaacaccaggcaaacgcccccaaatcatgatttatgaggtcaactaagcgcccctcgaggggttcccngactcgcttctcctgcctacaagtctggacctacgccggccctccctcgacccgtctcgtgggctcgaggctggacgatgaggtctgtattagtactgctagctcattaggngacgcagacgtaagttagttcggtggtacgggacggaacggaacgacggtacgtacgtaccgtacgtacgtacgaaccgtaccgacggtccgtacccgccccgttcgtacctacg

SEQ ID NO: 374763 - DNA, 720 bp, Homo sapiens
  misc_feature: GZ8MTXP02JPD23.22.15.B04.1.454.CMB.2.raw
  modified_base (289)..(289): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcacagtctgccctgactcagcctccctcgcgtccggtctcctggacagtcagtcaccatctcctgcactggaaccagcagtgacgttggtagtataactatgtctctgtacaacacaccagcaaacgccccaatcatgatttangagtcactagcgccctgacgggtccctgactcgtcttacccgtcgtcggtacctaccgtaacgtccgttacgggcccaaaaccgacccgggtcccccttaccccgtagggaaccccctaacttcccgtaccggtcgggtcccttacccggaaggtcccgttaaggaaagacgttaggaacgggtcttaggtaatttttaaacgttactggtccctttgtaccttacgttacttacggaccgtaccgggtacgtaccgttaccggttacggggtttcgggggttaccgggttaccgggggaacgggggtaaccgggtaacccgtaacgggtaccggttaacccgggtacccgttacggtaacggtaacccgtaaccggtaaaccccgggtacggtaccccggtaccccgggttcccccgtttaccggtcccg

SEQ ID NO: 374764 - DNA, 624 bp, Homo sapiens
  misc_feature: GZ8MTXP02G9EL2.22.15.B04.1.454.CMB.2.raw
  modified_base (224)..(224): a, c, t, g, unknown or other
  modified_base (247)..(247): a, c, t, g, unknown or other
  modified_base (294)..(294): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccngcagtgacgttggtgttatactntgtctctgtaccaacacaccagacaaacgccccaaatcatgtattangagtcactagccgcctcgacgggtcctgactcgcttctccgtgtcctcagtctacggacaccgaccggccctacccgtcgtacccgttctcgtcggggtcctaccggaggtccgtaggacggtagtcgggaacggtcttaggttaactttacgttacgtacggtactaacggtcttaacgtagttacgggtagggacgacgtacggtacgtaacgttaaggtttcggggtaggttcgggacgggacggtaaccacggtcgtaacggtcccgtacgtacgccgaaccgcccgtaacggtccctacccgtcccccgtacggtaccttacccg

SEQ ID NO: 374765 - DNA, 521 bp, Homo sapiens
  misc_feature: GZ8MTXP02IG54K.22.15.B04.1.454.CMB.2.raw
  modified_base (243)..(243): a, c, t, g, unknown or other
  modified_base (325)..(325): a, c, t, g, unknown or other
  modified_base (432)..(432): a, c, t, g, unknown or other
  modified_base (448)..(448): a, c, t, g, unknown or other
  modified_base (490)..(490): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctccctggacagtcagtcaccatctcctgcactggaaccagcagtgacgttggtgttanaactatgtctctgtacacaacaccagcaacgcccccaaatcatgatttatgagtcaactaagccggccctcgaggggtcccngatcgcttctctcgctcagtctggcacgcgccctcccgtcgacccgtctcgtgggcctcgaggctggaggatggacgtctagtattattactgcagctcagttgagngcagcgatagtttggngttcggacggacggaccaggcgtacggacccgtacgtacgcncgtcccgacggcctcgcccccgtgaccctcc

SEQ ID NO: 374766 - DNA, 533 bp, Homo sapiens
  misc_feature: GZ8MTXP02IKT1F.22.15.B04.1.454.CMB.2.raw
  modified_base (225)..(225): a, c, t, g, unknown or other
  modified_base (327)..(327): a, c, t, g, unknown or other
  modified_base (456)..(456): a, c, t, g, unknown or other
  modified_base (511)..(511): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagccctcctcactcagggcacagggtcctgggcccagtctgccctgactcagcctccctccgcgtccgggtctcctggacagtcagtcaccatctcctgcactggaaccngcagtgacgttggtgttataactatgtctcctgtaccaacaacacccaggcaaacgcccccaaatcatgtatttatgagtcaatagcgccctcagggtcccngatccgcttctctgctcaagtctggcacgcgcctccctgacccgtctctcgggctcgaggtctggagtactggacgtctgtacttatactggcagctacatagtggacgcaggcctaagtattttgggngttccggagggtaggaccaaggctacggccgtctaggccaacgcccgaaggtccnccgtccccgttcggactacccg

SEQ ID NO: 374767 - DNA, 602 bp, Homo sapiens
  misc_feature: GZ8MTXP02IXM48.22.15.B04.1.454.CMB.2.raw
  modified_base (221)..(221): a, c, t, g, unknown or other
  modified_base (243)..(243): a, c, t, g, unknown or other
  modified_base (310)..(310): a, c, t, g, unknown or other
  modified_base (323)..(323): a, c, t, g, unknown or other
  modified_base (346)..(346): a, c, t, g, unknown or other
  modified_base (370)..(370): a, c, t, g, unknown or other
tcagacatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctcctccgcgtccgggtctcctggacagtcagtcaccatctctgcactggaaccngcagtgacgttggtgtatactntgtctctgtacacacaccagacaacgccccaaatcatgattatgagtcactagcgcctcgcggtccngactcgcttctcngctcagtctgacacgcgcctccncgaccactctcgtcgggctaccgngtaccgtagaacgtagtaggacgtacgttagtaacttagtttactcgtcgttcgtacttaccagttactcggaccgacgggtcgtaactaaccggtttcggtttgggggttaccgggttccgggacggggtaacgggacccgaaggttaccgtaccggtaacccggttcccgttaacggtccggaacccggtaccccgtacggccctcccggtacccccgttggtaaccccc

SEQ ID NO: 374768 - DNA, 602 bp, Homo sapiens
  misc_feature: GZ8MTXP02JUYLU.22.15.B04.1.454.CMB.2.raw
  modified_base (225)..(225): a, c, t, g, unknown or other
  modified_base (250)..(250): a, c, t, g, unknown or other
  modified_base (297)..(297): a, c, t, g, unknown or other
  modified_base (324)..(324): a, c, t, g, unknown or other
  modified_base (409)..(409): a, c, t, g, unknown or other
tcagacatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtccaccatctcctgcactgaaccngcagtgacgttggtagttataactntgtctctcgtacaacaacaccagacaaacgaccccaaatcatgattngagtcacgtagccgcctgacgggtccngactcgcttctcgtcgctccaagtcgtacggacaccgaccgcctcccgtcgccgtctcgtcggcctccgaggtcgtacggaggtntggacgtcttagtattacgttacgtgccgtaagtcctagtaagtacggtaggaacgacgtacgaaccggtaagtttaacggttttcggggtacgggtacgggaccggggtaacggaacgacggtacgtcggtacccgttcgaaccggtcaacgaccccgtaaggcctcccggtcccccgtacgtccttacccg

SEQ ID NO: 374769 - DNA, 602 bp, Homo sapiens
  misc_feature: GZ8MTXP02HODKU.22.15.B04.1.454.CMB.2.raw
  modified_base (224)..(224): a, c, t, g, unknown or other
  modified_base (296)..(296): a, c, t, g, unknown or other
  modified_base (394)..(394): a, c, t, g, unknown or other
tcagacatacgcgtcacgaccggtgctcgatttagacagtatatatccgcggggagggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctctgcactggaaccngcagtgacgttggtgttaataactatgtctctggtaccaacaacaccagcaaacgccccaaatcatgattangagtacactaagcggccctcgacggggtccctgactcgtcttccctcgtcgctccaagtcgtggccaacgacggccctcccgtcgtacccgtctccgngggtccctccgaggcgtcggaggacgtggacggcttagatttagttactggtacagtctacagtacgtaggacggtacgaggtcgtaaacgtagtttacggggtcggttcggggacggggacgggtaaaccgaacggtcgtaccggtacccggtaccgttacggtcgacgacccgtaacggaccgtcccggtcccccgttacggtccc

SEQ ID NO: 374770 - DNA, 609 bp, Homo sapiens
  misc_feature: GZ8MTXP02I1EKR.22.15.B04.1.454.CMB.2.raw
  modified_base (218)..(218): a, c, t, g, unknown or other
  modified_base (258)..(258): a, c, t, g, unknown or other
  modified_base (346)..(346): a, c, t, g, unknown or other
  modified_base (348)..(348): a, c, t, g, unknown or other
  modified_base (359)..(359): a, c, t, g, unknown or other
tcagacatacgcgtcacgaccggtgctcgatttagacagtatatatccgcggggggggtctcaggaggcagcgctctcaggacgtctccaccatggcctgggctctgctattcctcaccttcctcactcagggcacagggtcctgggcccagtctgccctgacccagcctgcctccgtgtctggatcatcgtggacaggtcgatcagtctactttccngcacgtgggaaccaagtgtgactagttggttctttgactntcgtctctgtaaccaacaacgacccacgaccccaaacccccactcactactattagtgtctactactcgccgtccctgacgtctctcncntccgtctctcncgctacctagtcgtacggcaaacgccgtcctacccgtacactctacgtcgcctcgtacgttgacgtactacgtctattactacgtgtacttacgttactttaaagcgtaccgtacctacgttcgttacggtttcggttcgggtacggacgtacgtacgtacggtcgttacccgcggttacgtcgacccgtaccgtacggtcccgtcccgtcccgtacgtcccaccgtttacctcccgttacccctccccg

SEQ ID NO: 374771 - DNA, 564 bp, Homo sapiens
  misc_feature: GZ8MTXP01CTEKX.13.27.C05.1.454.CMB.2.raw
  modified_base (371)..(371): a, c, t, g, unknown or other
  modified_base (407)..(407): a, c, t, g, unknown or other
tcagtcacgtactacacgaccggtgctcgatttagacgcgatcgaagggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaacgccccgaactcctgactctacggtacatccactttgcacaggtggactcccatcaacggttcagtgcagtagatcgtgggaaactagtactttacccncacctagtcgaggggtctacgagcctaggaaagttnttttgaccgttacttactattacgtacaacgtagtacgtttacccttccgtccccggtacgtcgaccgtaacggaacgtaacggtacggaaagtcgaaacgacgttacgtggttacggcgtcacgaccactctcgtcttactcttcttcccgctaac

SEQ ID NO: 374772 - DNA, 565 bp, Homo sapiens
  misc_feature: GZ8MTXP01E2MXV.13.27.C05.1.454.CMB.2.raw
  modified_base (396)..(396): a, c, t, g, unknown or other
tcagtcacgtactacacgaccggtgctcgatttagacgcgatcgaagggtttgggggagtcagtctcagtcaggatacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtggatccatcaaggttcagtgcagtaagatctagggaacagtactttacccacaccatcgaggggtactacgagacctgaagtnttttgacgtacttactattagtacaaacgtagtacgttaaccttcccgtccccggtaacgtcggtaccgaacggacgtaaacggtaggaaacgtacgaagacgacgtcggttcggcgtcgcaccgttacttctacgttccttctacttcccgttcccgttccgtaaccg

SEQ ID NO: 374773 - DNA, 551 bp, Homo sapiens
  misc_feature: GZ8MTXP01DYAD3.13.27.C05.1.454.CMB.2.raw
  modified_base (366)..(366): a, c, t, g, unknown or other
  modified_base (510)..(510): a, c, t, g, unknown or other
tcagtcacgtactacacgaccggtgctcgatttagacgcgatcgaagggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagcccccgaactcctgatctacggtacatccactttgcacagtggatccatcaaggttcagtgcagtaagatctggaaactagtacttttacccncaccatcaggggtctacagcctagaagtattttgacgtacttactattagtcaaacgtagtacgtttacccttcgtacccccggtacgttcgccgaaacgggaccgtaacggtaggaacgtacgaaagcgaaactggttacggngtacgttcgcccatctagtctttcacttcttcccgcctaac

SEQ ID NO: 374774 - DNA, 742 bp, Homo sapiens
  misc_feature: GZ8MTXP01AZ8DI.13.27.C05.1.454.CMB.2.raw
tcagtcacgtactacacgaccggtgctcgatttagacgcgatcgaagggtttgggggagtcagtctcagtcaggacacagcatggacatgagggtccccgctcagctcctggggctcctgctactctggctccgaggtgccagatgtgacatccagatgagccagtcctccatcccaccctgtctgccgtctctcggagacagggtccaccatcctacgttggtccgggacaagtcaagtaactagttgggactaaacttactttaaagtggtatacagcaagaacgtcgacggaccaacgcccccgaacctcctagactacgtacggtactactacctacgtttgacctaacgtggtacggacctaccctagttacgtaacggttctaggtacggtacgtagtaaagacgtcgtacgtaaacgtacgttacctttacccgtactaacgtacgtaccgtacggggttacctaacgtacggtaccttaaggtaacgttagttttacgtaccgttaacgtttacgttaattacgtaaaccgtaaacggtaacggtttaacccgtttaccccgttccccggttaacccccggtaccggttaccgggtaacccggaaacgggtaaccgtaaacgggtaacgtaaacgtacggtaaacgacggttaacgtggttacgtacgtacgttaccgttaccgttattccttcgttaacccttactaccttaccccgtccgttaaccttaacg

SEQ ID NO: 374775 - DNA, 558 bp, Homo sapiens
  misc_feature: GZ8MTXP02IM3SL.13.27.C05.1.454.CMB.2.raw
  modified_base (363)..(363): a, c, t, g, unknown or other
  modified_base (392)..(392): a, c, t, g, unknown or other
tcagtcacgtactacacgaccggtgctcgatttagacgcgatcgaagggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagagtcaggcaagccccgaacctcctgatctacggtacatccactttgcacagtggactcccatcaagttcagtggcagtagatcgtgaacagtactttacccncaccatcgagggtctacgagcctagaatntttgcgtaacttactattagtacaaactagtactttacccttccgtacccccggtacgttccggaccgaacgggtaacccgaaggtaacggaaagtacgaaacggaccgtaacgtcggtaggctacgactaccgtatcgtcttacttcctattccttcccgctaac

SEQ ID NO: 374776 - DNA, 519 bp, Homo sapiens
  misc_feature: GZ8MTXP02ILCGT.13.27.C05.1.454.CMB.2.raw
  modified_base (332)..(332): a, c, t, g, unknown or other
  modified_base (355)..(355): a, c, t, g, unknown or other
  modified_base (409)..(409): a, c, t, g, unknown or other
tcagtcacgtactacacgaccggtgctcgatttagacgcgatcgaagggtttggggagtcagtctcagtcaggacacagcatggacatgagggtccccgctcagctcctgggctcctgctactctggctccgaggtgccagatgtgacatccagatgagccagtctccatccacctgtctgcgtctctcggagacagggtcaccatcacttgtcgggcaagtcagaacattggcaactcttaaatggtatcagcagagtcaggcaagccccgaactcctgatctacggtacatccatttgcacagtggatcccatcaagttcagtgcagtanatcgtgaaacagacttttacccnaccatcagggtctacagcctgaaagtatttgcgtacttacgtattagtacaaanagtacgttaccttctacccccgtgttcgaccgaaggaaccgaggtagaaatacgaacgacgaaacgtgtaggctacgcctacataactcgtctctatcgttcccactacg

SEQ ID NO: 374777 - DNA, 542 bp, Homo sapiens
  misc_feature: GZ8MTXP01BL9PV.44.8.A08.1.454.CMB.2.raw
  modified_base (479)..(479): a, c, t, g, unknown or other
  modified_base (500)..(500): a, c, t, g, unknown or other
tcagacagtatatacacgaccggtgctcgatttagcatactctacaggggagctgtgggctcagaagcagagttctggggtgtctccaccatggcctggacccctctctggctcactctcctcactctttgcataggttctgtggtttcttctgagctgactcaggaccctatgtgtctgtggccttgggacagacagtccggatcacatgccacggagtcagcctcagatactatcatgcaacctggtaccagcagaagccggacacggcccctttagtgtcatctataggtaaataaccggcctcagggactcccgagaccgattctcgtcggcctcagcctacaagacaacacagtcttcctagaccatccacgttggggtacagggcgaagtatcggcgctgactactacgtgtacgcgtccgtcgtccgaccgactacccaaccgtctccggttggtcgttcggcggcggaacngctcggaccgtcgtgggttcncgcccgaagccgtccgcccctggttcctaacgttcgttcccg

SEQ ID NO: 374778 - DNA, 676 bp, Homo sapiens
  misc_feature: GZ8MTXP01CNDHK.44.8.A08.1.454.CMB.2.raw
  modified_base (204)..(204): a, c, t, g, unknown or other
  modified_base (325)..(325): a, c, t, g, unknown or other
tcagacagtatatacacgaccggtgctcgatttagcatactctacaggggggggtcacaagaggcagcgctctcgggacgtctccaccatggcctgggctctgctgctcctcactctcctcactcaggacacagggtcctgggcccagtctgccctgactcagcctgcctcgtgtctgggtatcctggacagtcgatcaccttntcctgcactggactcagcagtgagctactaacttcttaatgtcgcctcctgtatcaacacactcccgacaaaccccccaatctagactcatgaaatctactaagcgtcctgtggtatttcngactccgtcttctcgtcgtcctaccgaggtcccggactaaaccgaccggcccctcctacgactaactctcgtcgggcctccgaacgcccgtaggaacggaccgaggtaacttaaaattctttcgtcgtttaccctactaaatttactaccgtacgtttccgtttggtttgggtttacgggtccgtttcggggcggggtaacggggtccggtaaggtccggttaaaccgtttccggttaacgggttcccgtaacggcccccggttaaagggttccccgttccccgggtcccccccgttcggggttaccctacccgtttcccggttaacccgtttcccccccgtttaaccccg

SEQ ID NO: 374779 - DNA, 727 bp, Homo sapiens
  misc_feature: GZ8MTXP01DK6CN.44.8.A08.1.454.CMB.2.raw
tcagacagtatatacacgaccggtgctcgatttagcatactctacaggggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctacaacttcttaatgtcgcctctggtatcaacacactcccggaccaaacccccaatctgacttcatgaaatctactaagccgccctcgtggtatttctgtactccgtcttctcgtacggtcctacccgtacgggtcccggactaaaccgacccgggtcccctacccgtacgaacctaacttccttcgtacgggcccttaccgaacggtcccgtagggaacgggtaaccgtaacgggtaaccttaaaagtttacttttccgttacgtttacccttactaatttaacttaaccgttaacggtttccgtttgggtttcggggtttccgggggtttccgttcgggggaccggggtacggggtacccggtaaggggttaccgttacccgggttaccgttacgggtccgaaccggttccccggttaacgggttcccgtcccggtccccccggttcgggttacccacccgtttccccgtcccggtttccccccttaacccccg

SEQ ID NO: 374780 - DNA, 285 bp, Homo sapiens
  misc_feature: GZ8MTXP02IYR0D.44.8.A08.1.454.CMB.2.raw
  modified_base (281)..(285): a, c, t, g, unknown or other
tcagacagtatatacacgaccggtgctcgattagcatactctacaggtcactggcacccagacaggttcagtggcagtgggtctgggacagacttcactctcaccgtcagcaatgtacagcctgaagatttgcagtttattactgtcagcagcgttcctccaggccgctcactttcggcggggaccaaggtggagatcagacgaactgtggctgcaccatctgtcttcatcttcccgccatctgatatatactgtctgagcgggctggcaaggcgcatagnnnnn

SEQ ID NO: 374781 - DNA, 604 bp, Homo sapiens
  misc_feature: GZ8MTXP02I6IAL.44.8.A08.1.454.CMB.2.raw
  modified_base (205)..(205): a, c, t, g, unknown or other
  modified_base (330)..(330): a, c, t, g, unknown or other
tcagacagtatatacacgaccggtgctcgatttagcatactctacagggggggtcacaagaggcagcgctctcgggacgtctccaccatggcctgggctctgctgctcctcactctcctcactcaggacacagggtcctgggcccagtctgccctgactcagcctgcctccgtgtctgggtatcctggacagtcgatcaccttcncctgcactggactcagcagtgaggctcaacttctaatgtcgcctcctggtatcaacaacatccccggacaaacccccaatcttgattcatagaaaatctactaacgccgccctgtcggtatttcngactccgtcttctctcgctccgagggtccggacaacgacgcctccctgacatctcgtcggctccgagtcgtgacggacgaggtactaaattatttctcgtttcctactattatactacgttcgtttggtttcgggttgggttcgtttcggggacgggacgggtaccggtaagggttcggtaaccggtcgttaaacgggttccacggaccccgtaagggtcctaaccggtcccccgttcggtccctaccggttccttccgtttaccccctacccc

SEQ ID NO: 374782 - DNA, 506 bp, Homo sapiens
  misc_feature: GZ8MTXP02H4QNT.44.8.A08.1.454.CMB.2.raw
  modified_base (227)..(227): a, c, t, g, unknown or other
  modified_base (264)..(264): a, c, t, g, unknown or other
  modified_base (324)..(324): a, c, t, g, unknown or other
  modified_base (346)..(346): a, c, t, g, unknown or other
  modified_base (453)..(453): a, c, t, g, unknown or other
  modified_base (468)..(468): a, c, t, g, unknown or other
tcagacagtatatacacgaccggtgctcgatttagcatactctacaggggagctgtgggctcagaagcagagttctggggtgtctccaccatggcctggacccctctctggctcactctcctcactctttgcataggttctgtggtttcttctgagctgactcaggaccctactgtgtctgtgccttgggacagacagtccggatcacatgccacggagtcagcctnagatacatcatgcaacctggaccagcagaacgcgganacggccctttagtgcatctatggtaaaataccggcctagagggactccagaccgtatctncgctccagctcaagacacacanccttcctagaccatcacgtgggtcaggcgaagatgcgctgactactactgtagtcctccgtgtcgcactaccaacgtctcgggttggcgttcgcgggcggacaggcncgaccgcgtcggccncggcccaaggcctacgcccccgtggcctacctctcccg

SEQ ID NO: 374783 - DNA, 601 bp, Homo sapiens
  misc_feature: GZ8MTXP02H7QMG.44.8.A08.1.454.CMB.2.raw
  modified_base (241)..(241): a, c, t, g, unknown or other
tcagacagtatatacacgaccggtgctcgatttagcatactctacagggggggtcacaagaggcagcgctctcgggacgtctccaccatggcctgggctctgctgctcctcactctcctcactcaggacacagggtcctgggcccagtctgccctgactcagcctgcctccgtgtctggtatcctggacagtcgatcaccttctcctgcactggactcagcagtgagctcaacttcttaangtcgcctcctgtatcaacacacgtcccgaccaaacccccaactctagacttcatacgaaatctactaagccgtccctgtggtactttctgactccgcttctcgtcggtcctccgaggtcccggaccaaacgtcccggtccctacccgtcgaaactaactccctcgtcgggtacctcccgaggccctaggacggacgaaggtaccttaaattacttcttacgttccactattactacgtacgtttcgttggttcgggtttacgggtcttcggggacggtacggggacccgtagtcggtaccgtcgtaggctacgcccgtagccgtcgtcccccgtcgtactcgtcctccgttacccgtccc

SEQ ID NO: 374784 - DNA, 630 bp, Homo sapiens
  misc_feature: GZ8MTXP02ID5GX.44.8.A08.1.454.CMB.2.raw
  modified_base (265)..(265): a, c, t, g, unknown or other
  modified_base (420)..(420): a, c, t, g, unknown or other
  modified_base (578)..(578): a, c, t, g, unknown or other
tcagacagtatatacacgaccggtgctcgatttagcatactctacaggggagctgtgggctcagaagcagagttctggggtgtctccaccatggcctggaccccctctctggctcactctcctcactctttgcataggttctgtggtttcttctgagctgactcaggaccctactgtgtctgtggccttgggacagacagtccggatcacatcgccacggatcagcctcagatactatcatgcaactggtacagcagagccgganacggcccctttagtgtcatctagtaggtaaaacttaccggcctgagggtactcccgagaccgattctctcggcctccgacgctacaacgactaacgacacgtcctttaccttcgaaccattccaccgttgggggtacccaggggccggtaaaagngtacggccggtgtacgaaccttacgtacgtacgtacgtcccgttcccgttcgtccgaccggtaactacccgtaaccggttccttccgggttcgggttcgttccggggacggtcccggggaacgtacggtacctacggtacccgttccgtcggggaccncggtacccgaacggtcctccggtcccccgtaggtcctaccgttcgttccccg

SEQ ID NO: 374785 - DNA, 613 bp, Homo sapiens
  misc_feature: GZ8MTXP02IUNRE.44.8.A08.1.454.CMB.2.raw
tcagacagtatatacacgaccggtgctcgatttagcatactctacaggggggggtcacaagaggcagcgctctcgggacgtctccaccatggcctgggctctgctgctcctcactctcctcactcaggacacagggtcctgggcccagtctgccctgactcagcctgcctccgtgtctgggtatccgtggacagtcatcaccttctcctgcactggactcagcagtcgagctacaactttcttaatgtccgtcctcgtgtatcaacaacactccccgaccaaacccccaactcttagattcatacgaaatctactaacgccggtccctcgtgggtactttctagtactccgtcttacgtctcggtactccgtaacggtccggacaccgaccggtccctccctaggactaactcgtcgtacggtcctcgacgtccgtaggacgggtacgtaagggtacctaaagtttcttacttcgttaccctataactacttaccgtacgttcgttggttgggtttcggtcgttcgggacggtaggccggtaggtcgtaccgtcgtacgtcgaccgccgacggtcctccgtcccgtacgtctacgtccttcccgtccgtcccc

SEQ ID NO: 374786 - DNA, 668 bp, Homo sapiens
  misc_feature: GZ8MTXP02HQNVR.44.8.A08.1.454.CMB.2.raw
  modified_base (225)..(225): a, c, t, g, unknown or other
tcagacagtatatacacgaccggtgctcgatttagcatactctacaggggagctgtgggctcagaagcagagttctggggtgtctccaccatggcctggacccctctctggctcactctcctcactctttgcataggttctgtggtttcttctgagctgactcaggaccctactgtgtctgtgccttgggacagacagtcgatcacatcgccaggatcagcctanagatactatcatcgacaccgtggaccagcagaacggccggacacggtccctttaggtgtacatctaagtacggtaaaactaccggccctagagggtactcccgagaccgtattcgtacgtcggcctaccgagtcctacaacgaacaccgacacgtcctttccgtagaccctatcccgacggtttgggtaccaggggacggtaagacgtcggaccggtctacgtaaccttaccgtacgttaacggtccgtcccgtttcccggttaggtaccccgacccgttaacgtaacccccgtaacccgggtttccgtaccggggtttcggggtccggttcccggggcgggaccccgggtacacgggtacctccgggtacccggttcgtacggggtccaacccggccggaacggtccacccgtccccgtacggtcctaccttccgtaccccg

SEQ ID NO: 374787 - DNA, 566 bp, Homo sapiens
  misc_feature: GZ8MTXP01DX2V0.51.26.C04.1.454.CMB.2.raw
  modified_base (282)..(282): a, c, t, g, unknown or other
  modified_base (526)..(526): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattacncagacgccgtgaggggccattcaccatctccagagacaattccgggaacacactgtctctgacaaatcgaacagcctgagaagctggaggacaggggcttggtttattactgtgtgcgactccgacctcacgtgggtacgggagttactcctcgactaacggtagtggacgtcgtcggggaccaagggaccacggtcaccgtctcctagccctccacgacgggcccagtccggtccttccccgnggcccaaccctcctccaacgcgcctaaccgttcgtcgggg

SEQ ID NO: 374788 - DNA, 383 bp, Homo sapiens
  misc_feature: GZ8MTXP01CSAJX.51.26.C04.1.454.CMB.2.raw
  modified_base (380)..(383): a, c, t, g, unknown or other
tcagcgatcgtatacacgaccggtgctcgatttagtctagcgactttgggtttgggaatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgatttcggcggagggaccagtctgaccgtcctaggtcagcccaaggctgccccctcggtcactctcgtcccgcctcctctcgtagccactctgagcggctggcaaggcgcatagnnnn

SEQ ID NO: 374789 - DNA, 586 bp, Homo sapiens
  misc_feature: GZ8MTXP01DFZIY.51.26.C04.1.454.CMB.2.raw
  modified_base (281)..(281): a, c, t, g, unknown or other
  modified_base (306)..(306): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactggggtgcgccgggctccaggcaaggggctggagtgggtgctgttataacttctgatggagtacaacatatacncagacgcgtgagggccatcacatcncagagacaattccggaacacactgtactctgacaaatcgaaacagcctagagaagctgaggacagggtctagtttatacgtgtgtgcgactccgacctcacgttgggtacgggtagttaccttccgtaccgacgtaacggttacgtgggtacgtcgtcggggaccaaacgggccgaacggtccaacccgtctcccgttaacgccctccaaccgaacgggcccagtccggtccttccccgttgcccaaccctcctccaacgacgctaacccgttcgcgggg

SEQ ID NO: 374790 - DNA, 563 bp, Homo sapiens
  misc_feature: GZ8MTXP01DZV0Y.51.26.C04.1.454.CMB.2.raw
  modified_base (466)..(466): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtcgtccgtgtccccaggacagacagccaccatcactgctctggatattaagtttggggtactaagtattgtttcgtggtatcaacatcacccaggcccggtcccgatactgcctcctctatcatgactgaccaagccggccctgagggactcccgtgagcgtacttctctggcctccaaacgtcgtggggacacacgccactctacgaccacgtccggcggacccgaggtccgtggtggatggaggctagacttattacgtgggtacgagggtcgtgggacgagggngcgtgcgtagttcgggcggaggccaggttcgtcggaccgtcgtacggttccgcgacccgaaggcctccggccccgtcggacctccgttctttccccg

SEQ ID NO: 374791 - DNA, 532 bp, Homo sapiens
  misc_feature: GZ8MTXP01A1D8T.51.26.C04.1.454.CMB.2.raw
  modified_base (334)..(334): a, c, t, g, unknown or other
  modified_base (366)..(366): a, c, t, g, unknown or other
  modified_base (427)..(427): a, c, t, g, unknown or other
  modified_base (490)..(490): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgtttcgtggtatcaacatcacccaggccgtccccgatactgctcctctatcatgatgccaagcggccctcagggatccctgagcgattctntggctccaaactctggggacacagccactctnacccatccgcgggacccaggcctgtggatgaggctgactattactggtcaggcgtgggacnggggaggcgtggccgtagttttcggcgggtgggaaccgaggttctcggccgtccgtaggttcncggcccaacgggctcggccccctcggcctaacgttcttcccg

SEQ ID NO: 374792 - DNA, 549 bp, Homo sapiens
  misc_feature: GZ8MTXP01EAH18.51.26.C04.1.454.CMB.2.raw
  modified_base (413)..(413): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggaggcgtggtccagcctgggaggtccctcagactctcctgtgcagcctctggcttcaccttcgacaacttttaatatgcactgggtgcgccggctccaggcaaggggctggagtgggtggctgttataacttctgatggaggtacaacatatactcagacgcgtgaggggccgattcaccatctccagagacaattccgggaacacactgtctctgcaaatcgaacagcctgagaagctgagacagggctgtttatactgtgtgcgatccgactcactgggtacgggngtacttcctcgcaacggtagtggacgtcgtggggccaagggaccacggtcaccgtctccttagcctccacaagggccccagtccggtccttccccgttggccaaccctcctccaagcgctaaccgttcgtcggggg

SEQ ID NO: 374793 - DNA, 533 bp, Homo sapiens
  misc_feature: GZ8MTXP01AQK43.51.26.C04.1.454.CMB.2.raw
  modified_base (445)..(445): a, c, t, g, unknown or other
  modified_base (498)..(498): a, c, t, g, unknown or other
  modified_base (523)..(523): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataagttggggtctaagtatgtttcgtggtatcaacatcacccaggcccggtccccgatactgctcctctatcatgatgccaagcggccctcagggactccctgagcgacttctctggctccaaactcgtggggacacacgcccactctcgacccacgtccgcgggacccaggctgtggatgaggctgactattactgggtcgagggcgtgggacaggggnggcgtaggcgtagtttcgggcggtagggccaggttcgtgccgtcgtaggttcncgccgaaggctcgcccctggttccncgttcgtccg

SEQ ID NO: 374794 - DNA, 587 bp, Homo sapiens
  misc_feature: GZ8MTXP01E3K7H.51.26.C04.1.454.CMB.2.raw
  modified_base (280)..(280): a, c, t, g, unknown or other
  modified_base (557)..(557): a, c, t, g, unknown or other
  modified_base (571)..(571): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggagtacaacatatacncagacgccgtgagggccgattcaccatctccagagacaattccgggaacacactgtctctgacaaatcgaacagcctgagaagctgaggacagggtcttgtttatactgtgtcgcgtactccgacctcgacgttacggtacgggtacttacctccgtccgacgtaaccggtaggtcggtacgtccggtacgggaccgaacgggcccgacggtccctaccgtcctacctaccgccctaaccaccgacggacccttcgtcccgtcccttcccgcgcccnccctcgaacacgcnccgtccgttcggcggg

SEQ ID NO: 374795 - DNA, 560 bp, Homo sapiens
  misc_feature: GZ8MTXP01D2WN2.51.26.C04.1.454.CMB.2.raw
  modified_base (223)..(223): a, c, t, g, unknown or other
  modified_base (494)..(494): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtcgtccccaggacagacagccacatcactgctctgganataagttggggtactaagtatgtttcgtggtatcaacatcaccaggccgtcccgatactgcctcctctatcatgatcgaccaagccggccctcgagggactcccgtgacgcgtacttctcgtggcctccaaactcgtggggacacgacgccactctcgacccacgtcccggcggacccgaggcctggtaggagtggacggctagacttattacgtggtacgagggagtgggacgaggggaggcgtaggcgtagtttcggcgggtaggaacngttcgtcgacgtcgtagttcgcgcccgaaggcctccgccccgtcggttcctaaccttccgttcccg

SEQ ID NO: 374796 - DNA, 577 bp, Homo sapiens
  misc_feature: GZ8MTXP01EXE5Y.51.26.C04.1.454.CMB.2.raw
  modified_base (280)..(280): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttatacttctgatggaggtacaacatattacncagacgccgtgaggggccgattcaccatctccagagacaattccgggaacacactgtctctgacaaatcgaacagcctgagaagctgagacagggcttgtttatactgtgtgcgatccgacctcaccgtgggtacggggagtttaccttccgtaccgacgaacggtagtcgggacgttcggtggggccaagggccacggtcaccgtctccttacgcctccacgaacgggcccagtccggtccttcccccgttggccctaacccctcctccgaacgacgctaaccgttcgtccggggg

SEQ ID NO: 374797 - DNA, 566 bp, Homo sapiens
  misc_feature: GZ8MTXP01AM98V.51.26.C04.1.454.CMB.2.raw
  modified_base (201)..(201): a, c, t, g, unknown or other
  modified_base (262)..(262): a, c, t, g, unknown or other
  modified_base (284)..(284): a, c, t, g, unknown or other
  modified_base (334)..(334): a, c, t, g, unknown or other
  modified_base (552)..(552): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaanatgcactgggtgccgccgggctccaggcaaggggctgggagtgggtggctgttataacttngatggaggtacaacatattacncagacgccgtggaggggccattcaccatctccagagacaattccgggaanacactgtctctgacaaatcgaaacagcctgagaagctggaggacgagggcttgtttatactgtgtgcgatccgactcacgtgggtacgggtattacttcctccgacgaacggtagtggacgtcgtacggggccaagggaccacggtccaccgtctccttacgcctccaccgacgggcccagtccggtcccttccccgttgcctaaccctcctcaagcnctccgttcgcgggg

SEQ ID NO: 374798 - DNA, 599 bp, Homo sapiens
  misc_feature: GZ8MTXP01E3OST.51.26.C04.1.454.CMB.2.raw
  modified_base (274)..(274): a, c, t, g, unknown or other
  modified_base (282)..(282): a, c, t, g, unknown or other
  modified_base (305)..(305): a, c, t, g, unknown or other
  modified_base (310)..(310): a, c, t, g, unknown or other
  modified_base (374)..(374): a, c, t, g, unknown or other
tcagcgatcgtatacacgaccggtgctcgatttagtctagcgactttgggtttgggctgagcgtggttttcctcgttagctctttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtgctgttataacttctgatggaggtacaanatattacnagacgcgtgagggcatcacatcncaganactaagtccggaacacactgtctctgacaaatacgaacagcctagagaacgctgaggacgaggngtagtttattacgtgtgtgcgacgtaccgacctacgtacgtacgggtacggggtacgttacgttccgtccgtacgtaacggtacggtacggtacggtcggtacgggaccggaacggaccgaccggtaccgaccgtcctacctacgcctcccaccgacggaccgacgtccgtcccgttccccgttccgccaaccctccctccacgacgacctaaccgttcgtcggg

SEQ ID NO: 374799 - DNA, 574 bp, Homo sapiens
  misc_feature: GZ8MTXP01CEONX.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagataagtttggggtactaagtatgtttcgtggtatcaacgtcacccaggccgtcccgatactgctcctctatcatgatgaccaagccggccctcgagggactccctgacgcgtattcccgtcgtggtctcccaactccgtaggggcacgacgccactctacgaccacgtccgccggaccaggctagtggagtgaggctaggactattactggtcgagggtcggtgggacgagggagcgtgcgtgtttcggcggtagggcaaggtcttcggtaccgttcggttacggcgaccggcccgaaacggtccgtccggtcccccgttcgggtccgttaccttccgttccgttcccccg

SEQ ID NO: 374800 - DNA, 574 bp, Homo sapiens
  misc_feature: GZ8MTXP01CSH0R.51.26.C04.1.454.CMB.2.raw
  modified_base (281)..(281): a, c, t, g, unknown or other
  modified_base (531)..(531): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttataacttctgatggaggtacaacatattacncagacgccgtgaggggccgattcaccatctccagagacaattccgggaacacactgtctctgcaaatcgaacagcctgagaagctgaggacagggctgttattacgtgtgtgcgatccgacctcgacgtgggtacggggtagttacttcctccgacaacggtagtcggacgtcgtcggggccaacgggaccacggtccaccgtcctccttacgccctccaccgacgggcccagtccggtccttcccccgnggcccaaccccgtcctccaagacgcctaaccgttcgtccgggg

SEQ ID NO: 374801 - DNA, 534 bp, Homo sapiens
  misc_feature: GZ8MTXP01A041D.51.26.C04.1.454.CMB.2.raw
  modified_base (260)..(260): a, c, t, g, unknown or other
  modified_base (282)..(282): a, c, t, g, unknown or other
  modified_base (481)..(481): a, c, t, g, unknown or other
  modified_base (509)..(509): a, c, t, g, unknown or other
  modified_base (512)..(512): a, c, t, g, unknown or other
  modified_base (516)..(516): a, c, t, g, unknown or other
  modified_base (521)..(521): a, c, t, g, unknown or other
  modified_base (525)..(525): a, c, t, g, unknown or other
  modified_base (528)..(528): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctgggagtgggtgctgttataacttcngatggaggtacaacatattacncagacgccgtgaggggccgattcaccatctccagagacaattccgggaacacactgtctctgcaaatcgaacagcctgagaagctgaggacagggctgtttatactgtgtgcgatccgacctcactgggtacgggagttacttcctcgcaacggtagtggacgtcgtggggccaagggaccacggtcaccgtctcctancctcaccagggccagtcgtcttccccgngcncccnctcancgcnccngtcggg

SEQ ID NO: 374802 - DNA, 539 bp, Homo sapiens
  misc_feature: GZ8MTXP01DK427.51.26.C04.1.454.CMB.2.raw
  modified_base (314)..(314): a, c, t, g, unknown or other
  modified_base (392)..(392): a, c, t, g, unknown or other
  modified_base (431)..(431): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataagttggggtctaagtatgtttcgtggtatcaacatcacccaggccgtccccgatactgctcctctatcatgatgccaagcggccctnacgggatcccctgagcgattctctggctccaaactctggggacacagccactctgaccactccgcgggaccaggctgnggatgaggctgactattactaggtcgaggcgtgggacgngggagcgtgcgtagtttcgggcggtgggaaccaggttcgtcggacccgtcgtacggttacgcggacccgaacggcctcgcccccgtcggttcctaaccttcgtttccg

SEQ ID NO: 374803 - DNA, 562 bp, Homo sapiens
  misc_feature: GZ8MTXP01BIX9X.51.26.C04.1.454.CMB.2.raw
  modified_base (460)..(460): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggcccggtccccgatactgctcctctatcatgatgccaagccggccctcgaggggactccccgtgagccgtacttcctcgtcggcctcccaaacttcgtggggaccacgacgcccactctcgacccactcccgcgggaccccagggcctggtcggatggaggctgactattactggtcagggcgtgggacgngggagcgtggcgtagtttcgggcggagggaaccaggttcgtggaccgtcgtaggttccgcgccgaacggcgtcgccccgtcggttcctccgttccgttcccg

SEQ ID NO: 374804 - DNA, 609 bp, Homo sapiens
  misc_feature: GZ8MTXP01DA3WE.51.26.C04.1.454.CMB.2.raw
  modified_base (262)..(262): a, c, t, g, unknown or other
  modified_base (282)..(282): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggctttcaccttcgactaacttttaatatgcacgtgggtgcgccgggctccaggcaaggggctggagtgggtgctgttataacttngatggagtacaacatatacncagacgcgtgagggcattcacatctccagagacaattccgggaacacactgtctctgacaaatcgaacagcctgagaagctgaggacagggtctagtttatactgtgtgcgactccgacctcgacgtgggtacgggtagttaccttccgtcgacgtaacggtagtcggtacgtcgtcggggaccaacgggacccgtacggtaccaacccgttcctacccgttacgcccctaacccaacccgaacggggtcccacgttccggttcccttcccccgttggcccctaaccccgtcctccgaaacgcgacctaaccgttcggtaacggggg

SEQ ID NO: 374805 - DNA, 557 bp, Homo sapiens
  misc_feature: GZ8MTXP01B1VTL.51.26.C04.1.454.CMB.2.raw
  modified_base (282)..(282): a, c, t, g, unknown or other
  modified_base (440)..(440): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattacncagacgccgtgaggggccgattcaccatctccagagacaattccgggaacacactgtctctgcaaatcgaacagcctgagaagctgaggacaggggctgtttattactgtgtgcgatccgacctcacgtgggtacgggagttactcctcgcaacggtntggacgtcgtggggccaagggccacggtcaccgtctccgttagccctcaccgagggcccagtccggtcttccccgttggccaacccctcctcccaagacgccaaccgttcgcggggg

SEQ ID NO: 374806 - DNA, 558 bp, Homo sapiens
  misc_feature: GZ8MTXP01DB5U4.51.26.C04.1.454.CMB.2.raw
  modified_base (282)..(282): a, c, t, g, unknown or other
  modified_base (335)..(335): a, c, t, g, unknown or other
  modified_base (484)..(484): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtggctgttataacttctgatggaggtacaacatatacncagacgccgtgagggccgattcaccatctcagagacaattccgggaacacacngtctctgacaaatcgaacagcctgagaagctgaggacagggtctgttatactgtgtgcatccgactcacgtgggtacgggagttacttacctccgacaaccggtgtcggacgtcgtggggccaaggggccacgggtcaccgtctcctcncctccacgaacgggcccagtccggtccttccccgttcgccaacccctctccaagcgcctaaccgttcgtcgggg

SEQ ID NO: 374807 - DNA, 560 bp, Homo sapiens
  misc_feature: GZ8MTXP01ANE9B.51.26.C04.1.454.CMB.2.raw
  modified_base (258)..(258): a, c, t, g, unknown or other
  modified_base (280)..(280): a, c, t, g, unknown or other
  modified_base (317)..(317): a, c, t, g, unknown or other
  modified_base (437)..(437): a, c, t, g, unknown or other
  modified_base (536)..(536): a, c, t, g, unknown or other
  modified_base (545)..(545): a, c, t, g, unknown or other
tcagcgatcgtatacacgaccggtgctcgatttagtctagcgactttgggtttgggctgagcgtgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccggctccaggcaaggggctggagtgggtgctgttataacttntgatggagtacaacatattacncagacgccgtggaggggccgattcaccatctccaganacaattccgggaacacactgtactctgacaaatcgaacagcctgagaagctgaggacagggcttgttatatgtgtgcatccgactcacgtggtacggagttactcctcgacaacggtagnggacgtcgtcgggaccgaacgggccacggtcaccgtctaccttacgccctccaccgacgggcccacgtccggtccttccccgttggcccaacccttccnccaaggccnccgtcgttcggcggg

SEQ ID NO: 374808 - DNA, 568 bp, Homo sapiens
  misc_feature: GZ8MTXP01B0MEF.51.26.C04.1.454.CMB.2.raw
  modified_base (222)..(222): a, c, t, g, unknown or other
  modified_base (452)..(452): a, c, t, g, unknown or other
  modified_base (461)..(461): a, c, t, g, unknown or other
  modified_base (478)..(478): a, c, t, g, unknown or other
  modified_base (482)..(482): a, c, t, g, unknown or other
  modified_base (484)..(484): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggactccctggccgcctatgacctgactcagccacctcagtgtccgtgtcccaggacagacagccacatcactgctcgtgganataagtttggggtactaagtatgtttcgtaggtatacaacactccacccgacggcccggtccccgatactcgcctcctctatcatgatcgaccaacggccgtccctcgacgggtacttcccgagacgcgtacttcctcgtcggcctacccgaaaacgtcgtggggacaacgacaccactcacgacccacgcccgacgggaccctggcgtggagagtgacggctagacttntacgtgggngagggtcgagggaaggngggngngtgtcgtcggtcggtcggcggaacgtcgttcgtcgcgtcgtcgcgcgaccgaacgcgtccgccgtccgttcctccgttcgtccg

SEQ ID NO: 374809 - DNA, 570 bp, Homo sapiens
  misc_feature: GZ8MTXP01DK0FY.51.26.C04.1.454.CMB.2.raw
  modified_base (282)..(282): a, c, t, g, unknown or other
  modified_base (536)..(536): a, c, t, g, unknown or other
  modified_base (552)..(552): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattacncagacgccgtgaggggccgattcaccatctccagagacaattccgggaacacactgtctctgcaaatcgaacagcctgagaagctgaggacagggctgtttatactgtgtgcgatccgacctcacgtgggtacgggtagttacttcctccgcaacggtagtcggacgtcgtcggggaccaagggccacggtccaccggtctccttacgccctccaccaaggggccccagtccgggtccttcccccgttggcccncccctcctcccaagcncaacccgttcgccggggg

SEQ ID NO: 374810 - DNA, 542 bp, Homo sapiens
  misc_feature: GZ8MTXP01EMT1X.51.26.C04.1.454.CMB.2.raw
  modified_base (292)..(292): a, c, t, g, unknown or other
  modified_base (409)..(410): a, c, t, g, unknown or other
  modified_base (434)..(434): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagtataagtttggggtctaagtatgtttcgtggtatcaacatcacccaggccgtcccgatactgctcctntatcatgatgccaagcgccctcagggatcccctgagcgacttctctggcctccaaactcgtgggggacacgacgccactctcgacccactcccgcggacccaggctgtcggatgagnngatatactggtcaggcgtgggacnggggagcgtggcgtagtttcgggcggtagggaaccctagttcgtcgaccgtcgtacggcgcgcccgaaggcctccggtccccgtcgggttctaaccttccgttccccg

SEQ ID NO: 374811 - DNA, 548 bp, Homo sapiens
  misc_feature: GZ8MTXP01DV4HR.51.26.C04.1.454.CMB.2.raw
  modified_base (201)..(201): a, c, t, g, unknown or other
  modified_base (283)..(283): a, c, t, g, unknown or other
  modified_base (490)..(490): a, c, t, g, unknown or other
  modified_base (521)..(521): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaanatgcactgggtgcgccgggctccaggcaaggggctggagtgggtggctgttataacttctgatggaggtacaacatattacncagacgccgtgaggggccattcaccatctccagagacaaattccgggaacacactgtctctgacaaatcgaacagcctgagaagctgaggacagggcttagtttatactgtgtgcgatccgacctcacgtggtacgggattacctcctcgcaacggtagtggacgtcgtggggccaagggccacggtcaccgtctccttagcctccncaagggcccagtcgtccttccccgttgcccnccctctccagcgcaaccgttcgcgggg

SEQ ID NO: 374812 - DNA, 700 bp, Homo sapiens
  misc_feature: GZ8MTXP01CTM9M.51.26.C04.1.454.CMB.2.raw
  modified_base (262)..(262): a, c, t, g, unknown or other
  modified_base (284)..(284): a, c, t, g, unknown or other
  modified_base (345)..(345): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtcgtggggggaggcgtggtccagcctgggaggtccctcagactctcctgtgcagcctctggcttcaccttcgaactaactttaatatgcacgtgggtgcgccgggctccgaggcgaaggggctggagtgggtgctgtatactntgatggagtacaacatattacncagacgccgtgagggccattcaccatctacagagacaaagttccgggaacacactgtctcngacaaatcgaaacagcctgagaagctggaggacagggtctgtttaattactgtgtcgacgactccggacctacgtacgttacggggtaccggggtagtttacccttaccgtccggaacgtaaccgggttagtcggggtaaccggttcggtacgggggaccaaacggggacccgtaccgggtacctaacccggttccttacccgttaacgccccgttaacccgaacccggaaaccggggtccccttaacgttaccccggggtttcccctttcccccccgggttacgggcccctaaaccccctttcccggtcccaaaacgggccgaccccgtaacccgttcccgggtaacccggggg

SEQ ID NO: 374813 - DNA, 575 bp, Homo sapiens
  misc_feature: GZ8MTXP01C0PCP.51.26.C04.1.454.CMB.2.raw
  modified_base (222)..(222): a, c, t, g, unknown or other
  modified_base (249)..(249): a, c, t, g, unknown or other
  modified_base (323)..(323): a, c, t, g, unknown or other
  modified_base (334)..(334): a, c, t, g, unknown or other
  modified_base (352)..(352): a, c, t, g, unknown or other
  modified_base (378)..(378): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccacctcagtgtccgtgtccccaggacagacagccacatcacctgctctgganataagttggggtctaagtatgtttcgngtatcaacatcaccaggcccgtcccgatactgctctctatcatgatcgaccaagccggcctcgagggactccgngagcgtattcncgtggcctcaaaactcgngggacacgactccactcacgacccanccccggacgggaacccgtggcgtggagatgacgacgtacgtacgtacgtacgtcggtcgtaggtacgggacgggacggagggacggtcggtcggtcggtacggttacgggtcgggacgggtaacgtacgttcgtcgttacgtacgtacgttcgcgaccgaacgccgtccgtcccgtccgttccgtccgttccgtccg

SEQ ID NO: 374814 - DNA, 555 bp, Homo sapiens
  misc_feature: GZ8MTXP01BX179.51.26.C04.1.454.CMB.2.raw
  modified_base (257)..(257): a, c, t, g, unknown or other
  modified_base (279)..(279): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcgaggggctggagtgggtgctgttatacttngatggaggtacaacatattacncagacgccgtgaggggccgattcaccatctccagagacaattccgggaacacactgtctctgcaaatcgaacagccctgagaagctgaggacagggctgtttatactgtgtgcgatccgacctcacgtggtacggggagttacttcctccgcaacggtagtggacgtcgtggggaccaagggccacggtcaccgtctcctacgcctccacgagggcccagtccggtccttccccgttggccaaccctccctccacgacgctaaccgttcgtcgggg

SEQ ID NO: 374815 - DNA, 549 bp, Homo sapiens
  misc_feature: GZ8MTXP01BE192.51.26.C04.1.454.CMB.2.raw
  modified_base (281)..(281): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattacncagacgccgtgaggggccgattcaccatctccagagacaattccgggaacacactgtctctgcaaatgaacagcctgagaagctgagacagggctgtttatactgtgtgcgatccgactcacttgggtacggggtacttacgttcctccgacaaccggtagtggacgtcgtggggccaagggcccacggtcaccgtctccttagcctccaccagggcccatcggtcttccccgttgccaacccgtctccagacgcaaccttcgcgggg

SEQ ID NO: 374816 - DNA, 692 bp, Homo sapiens
  misc_feature: GZ8MTXP01BPKQ5.51.26.C04.1.454.CMB.2.raw
  modified_base (261)..(261): a, c, t, g, unknown or other
  modified_base (283)..(283): a, c, t, g, unknown or other
  modified_base (315)..(315): a, c, t, g, unknown or other
tcagcgatcgtatacacgaccggtgctcgatttagtctagcgactttgggtttgggctgagcgtgggtttcctcgttgctctttaagaggtgtccagtgtcaggtgcacctggtggagtctgggggaggcgtggtccagcctgggaggtccctcagactctcctgtgcagcctctggcttcaccttcgaactaacttttaatatgcacgtgggtgccgccgggctccgaggcaaggggctggagtgggtgctgttatactntgatggaggtacaacatatacncagacgcgtgaggggcattcacatctccaganacaattccgggaacacactgtctctgacaaatcgaacagcctgagaagctgagacagggctgtttatactgtgtgcgtatccgacctcgtacgttggggtaacgggtacgtttaccttcccgttaccggacgttaaaccgggttaggtacggggtaaccggttccggttacgggggacccaaacgggggaccccgtaacggggttcccacccggttccttacccgtttaacggccccttaacccgaacccgttaaaccgggggcccccttaacggttcccgggttccccttttcccccccgttggggccccctaacccccgttccccgtaacccaaaacgggaccccgttacccgtaaccccggttcgggtccgggg

SEQ ID NO: 374817 - DNA, 706 bp, Homo sapiens
  misc_feature: GZ8MTXP01A7QOZ.51.26.C04.1.454.CMB.2.raw
  modified_base (223)..(223): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctgganataattggggtctaagtatgtttcgtggtatcaacatcaccaggccgtcccgatactgctcctctatcatgatgccaagccggccctcgaggggactcccctgacgcgtacttcctcgtcggcctacccgaaaacttccgtcgggggaccaaccgacgccccaactcctacgacccaacgtcccggaccggggaccccaagggcccgtgggttagggaagttcggaaggtcgttacggtaaccgttaatttaacccgtggggttacgaaggggtacccgggttacgggggaagaaccgggggagggccgttgggcccggtaaggtttttcccggggacggggaacggggaacccgtaacggttccgttacggacccggttaccccgttaaggggttacccgcgggaacccccggtaaacgggccccgttccggtccccccccggttacggggttaccctcccgttcccgttttccccccgggg

SEQ ID NO: 374818 - DNA, 546 bp, Homo sapiens
  misc_feature: GZ8MTXP01CQM0V.51.26.C04.1.454.CMB.2.raw
tcagcgatcgtatacacgaccggtgctcgatttagtctagcgactttgggttgggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagataattggggtctaagtatgtttcgtggtatcaacatcacccaggccggtccccgatactgctcctctatcatgatgccaagccggccctcagggatccctgagcgacttctctggctccaaactctggggacacagccactctcgacccatccgcgggacccaggcctgtggatgaggctgactattactgggtcagggcgtgggacagggaggctagcgtagtttcggccggagggaacccaggttcgtcgaccggttccgtagggttccgcgccccgaaagggtcctcgtccccccgtgggttcctaaccgttcctttcccg

SEQ ID NO: 374819 - DNA, 703 bp, Homo sapiens
  misc_feature: GZ8MTXP01D6N5C.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtcgtcccaggacagacagccaccatcacctgctctggagtattaagtttggggtactaagtattgtttcgtggtatcaacatcacccaggcccggtcccgatactgctctctatcatgatcgaccaagccggccctcgacgggtactcccgtgacgtccggtacttccgtcgtcggtccctacccgtaaaaaccgttccgtaacggggggaaacccaacccgacggtaccccctaaaccgttccgtacggaaaccccgtaacgttccccgggaccccgggggaaacccccggacgggtccgttagggtacgggtacgtacggacggtacgttacgtaacttacgttacgtcggggtacggaggggtcgggtaggggacgtagggggacgtcgtacgggtcggttacgggttacggggacgggtacgggaaccgtacggttccgtcggttacccgtacgtacggccgccgaccgtaacggtcccgtcccggtccccgtcggttcctccgttccgtcccg

SEQ ID NO: 374820 - DNA, 616 bp, Homo sapiens
  misc_feature: GZ8MTXP01AU4DW.51.26.C04.1.454.CMB.2.raw
  modified_base (261)..(261): a, c, t, g, unknown or other
  modified_base (535)..(535): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataagtttggggtctaagtatgtttcgtggtatcaanatcacccaggcccggtcccgatactgctcctctatcatgatgccaaggccggccctcgaggggactcccgtagacgccgtacttccgtcgtcggccctacccgaaaacttccgtcgggggaaccaccgacgcccactcgtacgacccagtcccggacgggaccccagggcctggtacggatcggaggtcctgtaacttagttacgtggggtacgagggtccggtaggggacgaggggacgcgtggcgttaggtttcgggcgggtacgggaacgnggttcgtcggaccgtcgtacggttccgcggttcccgaagggtcctcccggtccccgtcggttccctccgttcgttccccgg

SEQ ID NO: 374821 - DNA, 547 bp, Homo sapiens
  misc_feature: GZ8MTXP01CWTH3.51.26.C04.1.454.CMB.2.raw
  modified_base (260)..(260): a, c, t, g, unknown or other
  modified_base (317)..(317): a, c, t, g, unknown or other
  modified_base (397)..(397): a, c, t, g, unknown or other
  modified_base (403)..(403): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagataagtttggggtctaagtatgtttcgtggtatcaanatcacccaggcccggtccccgatactgcctcctctatcatgatgccaagcggccctnagggatccctgagcgacttctctggctccaaactctggggacacagccactctgaccatccgcgggacccaggctgtggntgagcngactattacgtggtcgtaggcggtgggacgaggggagcgtggcgtagtttcgggcgggagggccgaggttcgtcgacccgttcgtaggttccgcgccccgaaggcctccggcccccgttcgggcctaaccgttccgttccccgg

SEQ ID NO: 374822 - DNA, 605 bp, Homo sapiens
  misc_feature: GZ8MTXP01DQ812.51.26.C04.1.454.CMB.2.raw
  modified_base (281)..(281): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatatacncagacgccgtgaggggccgattcaccatctccagagacaagttccgggaacacactgtctctgacaaatcgaaacagcctgagaagctggaggacgagggcttagtttattactgtgtgcgactccgacctcacgtgggtacgggtacgttacttcctaccgacgtaacgggtagtcgggtacgtcgtcggggaccaacgggaccacggtccacccgtcctccgttacgccctccaccgaacgggccccacgtccggttccttcccccgttggttcccctaacccctccctaaccgaacgcgacctaaccgttcggtccggggg

SEQ ID NO: 374823 - DNA, 659 bp, Homo sapiens
  misc_feature: GZ8MTXP01D9AI9.51.26.C04.1.454.CMB.2.raw
  modified_base (202)..(202): a, c, t, g, unknown or other
  modified_base (258)..(258): a, c, t, g, unknown or other
  modified_base (278)..(278): a, c, t, g, unknown or other
  modified_base (304)..(304): a, c, t, g, unknown or other
  modified_base (309)..(309): a, c, t, g, unknown or other
  modified_base (323)..(323): a, c, t, g, unknown or other
  modified_base (347)..(347): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaacttttaanatgcactgggtcgcgccggctccaggcaggggctggagtgggtgcttgtatacttntgatggagtacacatatacncagacgcgtgagggccatcaccatcncagancaattccgggaacncactgtctctagacaaatcgaacngcctagagagctggaaggactaggggtcttcgtttaaagtactgtgtgcgatccgacctgacgtgggtaacgggtacgttaccttccgtccgacgtaacggtacggtcgggtaacgttcgtacgggggacccaaacgggggaccctacggggtcctaacccggttcctacccgtttacgcccctaacccgaacccgaaagggggcccccttaaagttcccgggttaacccttcccccccgtttcgggacccctaacccccgtcccttaaccccgaaacggtaccgggcctaaccccggttcggtccgggggg

SEQ ID NO: 374824 - DNA, 666 bp, Homo sapiens
  misc_feature: GZ8MTXP01B2LGG.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcactgctctggagattagtttggggtactaagtattgtttcgtggtatcaacatcacccgaggcccggtcccgatactgctcctctatcatgatcgaccaaggccggccctcgacgggtactccccgtggacgcgtacttccgtcgtcggccctacccgaaaaccgttccggtcgggggaccaaccgaccggacccctaaccgtccgtacgaaccctacgtcccgggacccggggacccgagggtccgttgggttacgggacgttgggaacgggtcttagtaacttagttaccgttggggtacgtaggggtccgggtaggggaccggagggggacggtcgtacggtcggttagggttttccgggcggggacgggtaaccgtaggttcgtcggacccgttcgtaggttccgacgcccgaaggccgtccgtccccgtcggttcctccgttccgttcccg

SEQ ID NO: 374825 - DNA, 593 bp, Homo sapiens
  misc_feature: GZ8MTXP01CX7ES.51.26.C04.1.454.CMB.2.raw
  modified_base (177)..(177): a, c, t, g, unknown or other
  modified_base (223)..(223): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtccgtgtccccaggacagacagccacatcacctgctctgganataagttggggtactaagtatgtttcgtggtatcaacatcacccaggcccgtcccgatactgctctctatcatgatgccaagcgccctgagggatccctgagcgtacttctctggcctccaaactcgtcggggacacacgccactctacgaccactcccggaccgggacccaggtcctggtaggagtggagggctgaacttagttacgtgggttacgaggggtccggtaggggacgaggggacggcgtcggcgtagtttcggggcgggtagggaacccgtaggttccgtacggacccgttacgtcgggttaccgcgacccgaagggccctcccggccccgttcgggttccctaaccgttccgtttccccg

SEQ ID NO: 374826 - DNA, 628 bp, Homo sapiens
  misc_feature: GZ8MTXP01AE5J8.51.26.C04.1.454.CMB.2.raw
  modified_base (224)..(224): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctgganataatttggggtctaagtatgtttcgtggtatcaacatccacccgacggccgtcccgatactgctcctctatcatgatgcagcgccctgacgggactcctgacgcgacttcctcgtcggtcctcctaaaacgtcgtcggggaccaccgagccccactctcgaacccacgtcccggaccgggacccagggtcctgggtaggaccgttggacgggtctggtaacttagttaccgtgggttacggacgggtcgggtacggggacggagggggacggtcgtacgggtcggtaacggttttccggggacgggtacggggtaaccacggttcgtcggaccgttccggtaaggttccgcgacccgaagggtcctccggtcccccgtcgggttcctccgttccgttccccgg

SEQ ID NO: 374827 - DNA, 554 bp, Homo sapiens
  misc_feature: GZ8MTXP01AFFVS.51.26.C04.1.454.CMB.2.raw
  modified_base (279)..(279): a, c, t, g, unknown or other
  modified_base (530)..(530): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttataacttctgatggagtacaacatatacncagacgccgtgagggccattcaccatctccagagacaattccgggaacacactgtctctgacaaatcgaacagcctgagaagctgaggacagggcttgtttatactgtgtgcgatccgacctcacgtggtacggggtattaccttcctcgcaacggtagtggacgtcgcggggaccaaggccacggtcaccgtctccttacgcctcaccgaacgggcccagtccggtccttccccgttggcccaaccctcnccaagacgccaaccgttcgcgggg

SEQ ID NO: 374828 - DNA, 556 bp, Homo sapiens
  misc_feature: GZ8MTXP01CF9NE.51.26.C04.1.454.CMB.2.raw
  modified_base (391)..(391): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagataattggggtctaagtatgttcgtggtatcaacatcacccaggcccgtcccgatactgctcctctatcatgatgccaagccggccctcgacgggactcccctgacgtcgacttctctcggctccaaactctggggacacacgccactctcgaccatccgcggacccngcctggtcgatgaggctgactatctggtcgaggcggtgggacgaagggcggacgtggcgtaagtttcggcgggagggaacctggttcgtcggacccgtccgtagggttccgacggcccgaaggcccgtcgcccccgtcgggttcctaacccttccgtttccccgg

SEQ ID NO: 374829 - DNA, 582 bp, Homo sapiens
  misc_feature: GZ8MTXP01C4W89.51.26.C04.1.454.CMB.2.raw
  modified_base (177)..(177): a, c, t, g, unknown or other
  modified_base (352)..(352): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtccgtgtccccaggacagacagccacatcactgctctggatataagtttggggtactaagtattgtttcgtggtatcaacatcacccgacggcccggtccccgatacgtcgctcctctatcatgatcgaccaagccggccctcgacgggactcccgtgacgcgtacttctntcggcctccaaactcgtcgggacacacgccactctacgacccagtcccgacgggacccaggcctgtaggagtgacggctgactagttactgggtcgagggtcggtaggggacgaggggcgtcgtggcgttaggttcgggacggacgggtaacaggttcgacgcccggttacgacggttacgcggcccgaacggtccgtccgtccccgtggttacctcgttcccgttcccg

SEQ ID NO: 374830 - DNA, 583 bp, Homo sapiens
  misc_feature: GZ8MTXP01ENN91.51.26.C04.1.454.CMB.2.raw
  modified_base (482)..(482): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagtattaagtttggggtactaagtattgtttcgtggtatcaacatcacccaggcccgtcccgatactgctcctctatcatgatgccaagcgccctcgagggactcccgtgacgcgtacttcctctggcctcccaaacgttcgtcggggaccacgacgcccacgtctcgaccacgtcccggacggacccgaggcctggtaggacgtggacgggtctgaacttattaccgtgggtcgaggggtcggtagggacgaggggcggngtggacgtgtttcgggcggtaggaactaggttcgtcgttaccgtcgtacggttcgacgcccgaagccgtccgccccgtcggttcctccgttccgttccccg

SEQ ID NO: 374831 - DNA, 620 bp, Homo sapiens
  misc_feature: GZ8MTXP01C0F0S.51.26.C04.1.454.CMB.2.raw
  modified_base (260)..(260): a, c, t, g, unknown or other
  modified_base (281)..(281): a, c, t, g, unknown or other
  modified_base (328)..(328): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgaactaacttttaatatgcactgggtgcgccgggctccaggcaaggggctggagtgggtgctgttatacttngatggagtacaacatattacncagacgccgtgagggccatcacatctccagagacaagttccgggaanacactgtctctgacaaatcgaacagcctgagaagctgaggacagggtctagtttatactgtgtgcgactccgactcgacgttgggtacgggtacgttacctccgtcgacgtaacggtagtcgggtacgtcgtcggggaccaaagggacccgacggttccaaccggttcctacccgttacgccccttaaccaaccgaaacggggccccttaacgttcccggtcccttcccccgttggacccctaacccctccctaacccgaaggaccgccctaacccgttcggtaaccggggg

SEQ ID NO: 374832 - DNA, 536 bp, Homo sapiens
  misc_feature: GZ8MTXP01DFVN2.51.26.C04.1.454.CMB.2.raw
  modified_base (530)..(530): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggaggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatatactcagacgccgtgagggccgattcaccatctccagagacaattccgggaacacactgtctctgacaaatgaaacagccctgaagagctgaggacagggctgttatactgtgtgcgatccgacctcacgtggtacggggagttactctccgcaaggggtattgggacgtcgtggggccaagggccaacgtcaccgtctccttagcctcacgacgggcccagtcggttccttccccttgcaccctctcagacncgcgtg

SEQ ID NO: 374833 - DNA, 623 bp, Homo sapiens
  misc_feature: GZ8MTXP01B0JJI.51.26.C04.1.454.CMB.2.raw
  modified_base (177)..(177): a, c, t, g, unknown or other
  modified_base (223)..(223): a, c, t, g, unknown or other
  modified_base (250)..(250): a, c, t, g, unknown or other
  modified_base (289)..(289): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtccgtgtccccaggacagacagccaccatcactgctctgganataagttgggtactaagtatgtttcgnggtatcaacatcacccagccgtccccgatactgctcctntatcatgatcgaccaagccggccctcgagggactcccgtgacgcgtacttccgtctcggcctacccaaaaccgttcgtcgggggaacaaccgacgacccaacgttccacggaacccacgtccccggacggggaccccaagggccgttggtaggtacgtcggaagggcctaggtaaccttagtttaaccgtggggtaaccgtaggggccggttaggggaccgaaggggcggccgtaggcggtacggtttcgggcgggagggtaacccgagttcgtcgaccgtcgtaacgttcgcgcccgaaggccttccggcccctcgggctccttcgttccccg

SEQ ID NO: 374834 - DNA, 537 bp, Homo sapiens
  misc_feature: GZ8MTXP01EV9AA.51.26.C04.1.454.CMB.2.raw
  modified_base (224)..(224): a, c, t, g, unknown or other
  modified_base (315)..(315): a, c, t, g, unknown or other
  modified_base (320)..(320): a, c, t, g, unknown or other
  modified_base (430)..(430): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctgganataattggggtctaagtatgtttcgtggtatcaacatcacccaggcccggtccccgatactgctcctctatcatgatgccaagcggccctnagggntccctgagcgacttctctggcctccaaactcgtggggacacagccatctgacccatccgcggacccaggctgtggatgaggctgatatactggtcgagggcgtgggacgnggggaggcgtggcgtagtttcgggcgggagggaacgagttctcggaccgtcgtacggttcgcgcccgaaggccgtcgccccgtcggttcctccgttcccgtttcccc

SEQ ID NO: 374835 - DNA, 532 bp, Homo sapiens
  misc_feature: GZ8MTXP01AIJ9M.51.26.C04.1.454.CMB.2.raw
  modified_base (427)..(427): a, c, t, g, unknown or other
  modified_base (492)..(492): a, c, t, g, unknown or other
tcagcgatcgtatacacgaccggtgctcgatttagtctagcgactttgggtttgggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttgggggtctaagtatgtttcgtggtatcaacatcacccaggccggtccccgatactgctctctatcatgatgccaagcggccctcagggatccctgagcgacttctctggctccaaactctggggacacagcccactctgacccatccgcggacccaggctgtggatgaggctgactatactggtcaggcgtgggacngggaggcgtggcgtagttttcgggcgggagggtaaccgaggttcgtcgaccgtcgtacggttcgngccccgaagggcctcgccccgtcggttcctcgttcttccg

SEQ ID NO: 374836 - DNA, 593 bp, Homo sapiens
  misc_feature: GZ8MTXP01CSVDV.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagataagttggggtctaagtatgtttcgtggtatcaacatcacccaggcccggtccccgatactgctcctctatcatgatgccaagccggccctcgagggactcccgtgagcgacttctctggctcccaaactcgtggggacacgcgaccactctacgacccacgtcccggaccgggacccgaggcctggtggatgagggctagacttagttacgtgggtcgagggtcggtaggggacgtaagggggcggcgtggtcggtaggtttcgggcggggtacggggtaaccgtaggttccgtacggaccggttccgtacgggttccgacggcccgaaggccctcgcccccgtcggttcctaaccgttcgttccccg

SEQ ID NO: 374837 - DNA, 535 bp, Homo sapiens
  misc_feature: GZ8MTXP01EDVMB.51.26.C04.1.454.CMB.2.raw
  modified_base (261)..(261): a, c, t, g, unknown or other
  modified_base (282)..(282): a, c, t, g, unknown or other
  modified_base (404)..(404): a, c, t, g, unknown or other
  modified_base (451)..(451): a, c, t, g, unknown or other
  modified_base (509)..(509): a, c, t, g, unknown or other
  modified_base (519)..(519): a, c, t, g, unknown or other
  modified_base (526)..(526): a, c, t, g, unknown or other
  modified_base (531)..(531): a, c, t, g, unknown or other
  modified_base (533)..(533): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcacctttcgacaacttttaatatgcactgggtgcgccgggctccaggcaaggggctggagtgggtgctgttataacttntgatggagtacaacatatacncagacgccgtgaggggccattcaccatctccagagacaaattccgggaacacactgtctctgcaaatcgaacagcctgagaagctgagacagggctgtttatactgtgtgcgatccgacctnaactggtacggggattacttcctcgacaacgggtatgggacgttcgngggggccaaggggccacggtcaccgtctcctagcctcacaggcccagtcgcttccccngcaaccctcnccagacnctcgngngg

SEQ ID NO: 374838 - DNA, 613 bp, Homo sapiens
  misc_feature: GZ8MTXP01CJD83.51.26.C04.1.454.CMB.2.raw
  modified_base (257)..(257): a, c, t, g, unknown or other
  modified_base (279)..(279): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttatacttntgatggaggtacaacatatacncagacgccgtgaggggccgattcaccatctccagagacaattccgggaacacactgtctctgcaaatcgaacagcctgagaagctgaggacagggctgttatactgtgtgcgatccgacctcacgtgggtacgggagttaccgttcctccggactaaccgggttagtcggggtaccgttcgtacgggggcccaaacggggcccgtacgggtccaacccggttcctcccgtttaacgccccttaacccaccgaaacggggccccacgtccgggtcccttcccccgttggccctaaccccgtcctaaccaacgcgcctaaccgttcggtccggggg

SEQ ID NO: 374839 - DNA, 734 bp, Homo sapiens
  misc_feature: GZ8MTXP01CV01R.51.26.C04.1.454.CMB.2.raw
  modified_base (282)..(282): a, c, t, g, unknown or other
  modified_base (351)..(351): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggaggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatatactnagacgccgtgagggccgattcacatctccagagacaattccggaacacactgtctctgacaaatgaacngcctaggaagagctggaaggacgagggtctagtttatacgtgtgtgacgactcccgtacctacgacggttagggttacgggggtactttaccgttacccgttaccgacgtaaaccgggggttagttacgggggtaaccgttccgggttacgggggaccccgaaacgggggtaccctaaaccgggggttccctaaccccgggttccttaccccgttttaacgccccgttaaccccgaacccggaaaccgggggttaccccctaacggttccccggggttacccccttttcccccccggttcccggggtcccctaaccccccccttccccgttaaccccgtaaaccgggttacccggaaccccgttaaccccggttccccggggg

SEQ ID NO: 374840 - DNA, 710 bp, Homo sapiens
  misc_feature: GZ8MTXP01BIGKK.51.26.C04.1.454.CMB.2.raw
  modified_base (222)..(222): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcactgctctgganataagttggggtctaagtatgtttcgtgtatcaacatcacccaggcccggtcccgatactgcctcctctatcatgactgccaagccggccctcgacggggactccccgtagacgcgtactttcctctcggtcctcccaaaacctccgtgggggaccaaccgacggcccctaactccgtacgaaccctacgtcccggaccgggaccccgacggccgtggtacggagtggacggcgtacgaccgttagtttaaccgttggggtacgacggggtacggtacgggggaaccggagggggacgggtccgtggggtaccggtaacgggtttttccggggaccgggttaagggggaacccgtaacgggttccgtaccggttacccggttacccgttaacgggttacccgttaccgggttaccccggtaaacgggcccgttcccgggtccccccgttccgggttaccccgtaacccgttccccggttttcccccgg

SEQ ID NO: 374841 - DNA, 647 bp, Homo sapiens
  misc_feature: GZ8MTXP01CYF3D.51.26.C04.1.454.CMB.2.raw
  modified_base (259)..(259): a, c, t, g, unknown or other
  modified_base (282)..(282): a, c, t, g, unknown or other
  modified_base (306)..(306): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctcaggcaaggggctggagtgggtggctgttataacttntgatggaggtacaacatattacncagacgcgtgagggccattcacanctcagagacaattccgggaacacactgtctctgacaaatcgaaacagcctagagaagctgaggacgagggcttaggtttatacgtgtgtgcgtactcccgacttacacgttcggggtaacgggggtactttaaccgtccctcggaccgtaaacgggtagtcgggtacggttccgtcgggggaccaacggggaccgtacggtaccgtacccggtctacccgttacggccctcccgaaccgaaccggggtcccaacggttcccggttccctttccccccgttgggttcccctaaccccgtcccttaaccgaacgaccgacctaaccccgttcggtcccggggg

SEQ ID NO: 374842 - DNA, 558 bp, Homo sapiens
  misc_feature: GZ8MTXP01CG0EW.51.26.C04.1.454.CMB.2.raw
  modified_base (258)..(258): a, c, t, g, unknown or other
  modified_base (279)..(279): a, c, t, g, unknown or other
  modified_base (406)..(406): a, c, t, g, unknown or other
  modified_base (422)..(422): a, c, t, g, unknown or other
  modified_base (432)..(432): a, c, t, g, unknown or other
  modified_base (437)..(437): a, c, t, g, unknown or other
  modified_base (543)..(543): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttataacttntgatggagtacaacatatacncagacgccgtgaggggccattcaccatctccagagacaagttcccgggaacacactgtctctgacaaatcgaacagcctgagaagctgaggacagggtctgtttatactgtgtgcgactccgacctnacgttgggtacgggtnttaccttccnccganaacggtgtggacgtcgtcggggcaagggccacggtcaccgtctccttacgccctccaccgacgggcccagtccggtccttccccgttgccctaacctcctcaagcncctcgttcgtcgggg

SEQ ID NO: 374843 - DNA, 657 bp, Homo sapiens
  misc_feature: GZ8MTXP01B09NB.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcactgctctggagattaagtttggggtactaagtattgtttcgtggtatcaacatcacccaggccgtcccgatactgctctctatcatgatcgccaagccgccctcgagggactccctgagcgtacttcctcgtggcctccaaactcgtggggacacgacgcccactctcgacccacgtcccggaccgggacccagggccgtggtacggagtggacgggtctacgtaacttacgtttaaccgtggggttacggaggggtccgggttacgggggacgacgggggtacggccgttacgggtccggttaagggttttcccggggaccgggggtaacgggtaaccgtaggttccggtacggttaccccggtaccgtacgggttccgaccgggaccccgaacgggtcccgtcccggtcccccgtcggttcctaaccgtttcccgttaaccccg

SEQ ID NO: 374844 - DNA, 565 bp, Homo sapiens
  misc_feature: GZ8MTXP01EBNPJ.51.26.C04.1.454.CMB.2.raw
  modified_base (261)..(261): a, c, t, g, unknown or other
  modified_base (366)..(366): a, c, t, g, unknown or other
  modified_base (531)..(531): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtggctgttataacttcngatggaggtacaacatatactcagacgccgtgaggggccgattcaccatctccagagacaattccgggaacacactgtctctgacaaatcgaacagcctgagaanctgaggacagggctgtttatactgtgtgcgatccgacctcacgtgggtacgggtagttactcctcgacaacggtagtcggtacgtcgtcggggccaagggccacggtcctaccgtctccttcgcctccaccacgggcccttagtccggtcttcccccgttggccncccgtcctccaacgcgcctaaccgttcgtcgggg

SEQ ID NO: 374845 - DNA, 673 bp, Homo sapiens
  misc_feature: GZ8MTXP01B6FFL.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtcccccaggacagacagccaccatcacctgctctggagataagttggggtctaagtatgtttcgtggtatcaacatcacccaggccggtccccgatactgctcctctatcatgatgccaagcgccctcagggactcccgtgagcgacttctctggcctccaaactctcggggactacgacgccactctcgacccacgtcccggccgggacccgaggtccgtggtacgggaagttcggacgggtctacggtaacgttaacgtttaaccgttgggggttaccgtaagggggtaccggttacgggggaaccggtaacgggggaacgggtccgttcgggtaccggttaacggtttttccgggggaccgggtaacggggaacccgtaacgggttccgtcgggttacccggtaccgttacgggttccgcggaccccgtaacggcccgtaaccggtccccccgtcgggttcctaacccgttccgtttcccccg

SEQ ID NO: 374846 - DNA, 559 bp, Homo sapiens
  misc_feature: GZ8MTXP01BYN8S.51.26.C04.1.454.CMB.2.raw
  modified_base (200)..(200): a, c, t, g, unknown or other
  modified_base (258)..(258): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaanatgcactgggtgcgccgggctccaggcaaggggctggagtgggtgctgttataacttntgatggaggtacaacatattactcagacgccgtgaggggccgattcaccatctccagagacaattccgggaacacactgtctctgcaaatcgaacagcctgagaagctggagacagggctgtttattactgtgtgcgatccgacctcacgtgggtacgggtattacttcctccgcgaacggtagtggacgtcgtcggggccaagggaccacggtcaccgtctcctagccctccaccagggcccagtccggtccttccccgttggccctaaccctctccaagcgcctaaccgttcgtcgggg

SEQ ID NO: 374847 - DNA, 572 bp, Homo sapiens
  misc_feature: GZ8MTXP01AN63B.51.26.C04.1.454.CMB.2.raw
  modified_base (258)..(258): a, c, t, g, unknown or other
  modified_base (280)..(280): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttatacttntgatggaggtacaacatatacncagacgccgtgaggggccgattcaccatctccagagacaattccgggaacacactgtctctgacaaatcgaacagcctgagaagctggagacgagggctgtttatactgtgtgcgatccgacctcacgtgggtacgggtattaccgtcctccgacaacggtgtcggacgtcgtacggggaccaagggccacggtcaccgtctccttagccctcaccgaacgggcccagtccggtccttccccgttggccctaacccctcctaaccgaacgcgcctaaccgttcgaaccgggg

SEQ ID NO: 374848 - DNA, 654 bp, Homo sapiens
  misc_feature: GZ8MTXP01DAGF3.51.26.C04.1.454.CMB.2.raw
  modified_base (221)..(221): a, c, t, g, unknown or other
  modified_base (240)..(240): a, c, t, g, unknown or other
  modified_base (560)..(560): a, c, t, g, unknown or other
  modified_base (600)..(600): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccacctcagtgtccgtgtccccaggacagacagccacatcactgctctgganataagttggggtctaagtntgttcgtgtatcaacatcacccaggcccggtcccgatactcgctcctctatcatgatcgaccaaggccggccctacgacgggactcccgtaggagtccgtactttcctcgtcggtccctacccgaaaaccgttcgtaacgggggaccaaccgacggtacccaacctccgtacgacccgaactccccgggaccggggaccccaacgggccgttagggttcgggaaggttcggaacgggccttaggtaacgttacttaaccggtgggtacgtaaggggacggttaggggacgagggggagtcgtaggtcgtaggttccgggnggacgggtctaacggttcgtacgccggtcgtaacgggccncggacccgtaaggcccgtccgtcccccgtcgggttactaacccgttcttccccg

SEQ ID NO: 374849 - DNA, 739 bp, Homo sapiens
  misc_feature: GZ8MTXP01B11D2.51.26.C04.1.454.CMB.2.raw
  modified_base (178)..(178): a, c, t, g, unknown or other
  modified_base (466)..(466): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcacgccaccctnagtcgtccgtgtccccaggacagacagccaccatcacctgctctggatattaagtttggggtactaagttattggttttcgtggttatcaaacactccaccccgacggcccggtaccccgatactcgcctcctctatcatgatcgacctaacggccggccctacgacgggacttccccgtagacgtcgtaccttcctcgtcggtaccctacccgtaaaaccgttcggtcgggggaaccaccgacgtcccctaacgtcctacgacccacgtcccggaccgggaacccgngggtccttagggtacgggtaacgtgggtaacgggtcgttacgtaacgttaacgtttaaccgtcggggttacgaacgggggtccgggtagggggaaccggtagggggacgggtcgtacgggtaccggttacgggtttccggggaccggggtaacgggaaccgtcggttaccggtacggttacccggttccggtaacgggttaccgaccggaccccgtaagggtccccgtcccggtcccccggtcggttccctaacccgtttccgtttccccccg

SEQ ID NO: 374850 - DNA, 704 bp, Homo sapiens
  misc_feature: GZ8MTXP01CPNUD.51.26.C04.1.454.CMB.2.raw
  modified_base (269)..(269): a, c, t, g, unknown or other
  modified_base (290)..(290): a, c, t, g, unknown or other
  modified_base (313)..(313): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtcgtggggggaggcgtggtccagcctgggaggtccctcagactctcctgtgcagcctctggcttcaccttcgaactaaacttttaatatgcacgtgggtgccgccgggctccgaggcgaaggggctggagtgggtgctagttataacttntgatggagtacaacatatacnagacgcgtgagggcatcacatcncagagacaacgtccggaacacactgtctcgtgaacaaatcgaacagccgtagaagaagcgtggaggacgaggggtcttagtttatacgtgtgtgaccgtaacgtcccgacctacgtacggttacgggggttaacgggtacgtttaaccttcccgtaccggacgtaaacgggttgtacggggtaacgggttcgacgggggaacccgaaacggggtaccccgacgggttacccaacccgttccgttacccgttaacccggcccgtaaccccgaaacccggaaaccggggtcccccaacggtttccccgggttaacccctttccccccggttggaccccctaacccctaccctaaccgaaacggccgttacccgaaccgttcgggtaaccgggg

SEQ ID NO: 374851 - DNA, 657 bp, Homo sapiens
  misc_feature: GZ8MTXP01BRB23.51.26.C04.1.454.CMB.2.raw
  modified_base (262)..(262): a, c, t, g, unknown or other
  modified_base (281)..(281): a, c, t, g, unknown or other
  modified_base (309)..(309): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaaacttttaatatgcacgtgggtgcgccgggctccgaggcaaggggctggagtgggtgctgttatacttngatgagtacaacatatacncagcgcgtgagggcatcacatctcaganacaattccggaacacactgtctctgacaaatcgaacagcctgagaagctgagacgagggcttagtttatacgtgtgtgcgtatccgacctcgtacgtcgggtacgggtactttaccgttccgtaccggtacgtaaccgggttaggtcgggtacggttcggtacggggaccgaaacggggacccgaccggttaccgtacccgttccgttacccgtttaccgcccttaacccgaaccggaaccggggtccccttacggttcccggttccccttcccccgttgggacccctaacccccttcccgaacccgtaaacggccgttacccgtaacccgttccgggtaaccggggg

SEQ ID NO: 374852 - DNA, 688 bp, Homo sapiens
  misc_feature: GZ8MTXP01AVTGP.51.26.C04.1.454.CMB.2.raw
  modified_base (298)..(298): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagtataagtttggggtactaagtatgtttcgtggtatcaacatcacccaggccggtccccgatactgctcctctancatgatcgaccaaggccggcccctgagggactccccgtgacgtcgtacttcctcgtggccctcccgaaaacttccgtggggacacgacgccctacgtctacggaccctacgtcccggaccgggaccccgagggtccgtggttacgggagttcggaacgggtctacggtaacttaacgtttaccgttagggggttaccgtaagggggtccggttacgggggaaccggaaggggggtcggtaccggtgggtccggttaagggttttccgggggcggggtaacggggcctaacgggttccgtcgggttaccccgttcggtaacgggttccgaccgccccgggtaagcccgtccggtcccccgtcgggttacctaaccggttcccttaaccccg

SEQ ID NO: 374853 - DNA, 682 bp, Homo sapiens
  misc_feature: GZ8MTXP01COD7R.51.26.C04.1.454.CMB.2.raw
  modified_base (212)..(212): a, c, t, g, unknown or other
  modified_base (258)..(258): a, c, t, g, unknown or other
  modified_base (281)..(281): a, c, t, g, unknown or other
  modified_base (309)..(309): a, c, t, g, unknown or other
  modified_base (353)..(353): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtncgccgggctccaggcaaggggctggagtgggtgctgttataacttntgatggaggtacaacatattacncagacgccgtgaggggccattcacatcncagagacaattccgggaacacactgtctctgacaaatcgaaacngcctgagaagctggaggacaggggtctgtttatactgtgtagcgatcccgactcgacgttgggtacggggtatttaccttcccgtaccgacgtaaaccgggttaggtacgggtaaccggttcgtacgggggacccaaagggggaccccaacggggttcccaaccggttccgtccccgttaacggtccccgttaaccccgaaacccgaaacgggggtcccccaaacgttccccggttcccctttcccccccggttgggacccccttaaccccccgtacccttaaccccgaaaacggtacccggaccctccccggttcggtaaccgggggg

SEQ ID NO: 374854 - DNA, 606 bp, Homo sapiens
  misc_feature: GZ8MTXP01BL7NP.51.26.C04.1.454.CMB.2.raw
  modified_base (285)..(285): a, c, t, g, unknown or other
  modified_base (319)..(319): a, c, t, g, unknown or other
  modified_base (550)..(550): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaactttaatatgcacgtgggtgcgccgggctccgaggcaaggggctggagtgggtggctgttataacttctgatggaggtacaacatattacncagacgccgtgaggggccatcaccatctccaganacaagttcccgggaacacactgtctctgacaatcgaacagcctgagaagctgagacgagggtcttagtttatactgtgtcgcgtactccgacctcacgtgggtacggggtattaccttcctccgataacggtagtcggtacgtcgtggggaccgaagggccacggtccaccggtcctccgttacgccctccaaccgacggggtcccttacgtcccgggtcccttcccccgngggacccctaaccccgtcctcccaaaggccgaccgtaaccgttccggtaacggggg

SEQ ID NO: 374855 - DNA, 640 bp, Homo sapiens
  misc_feature: GZ8MTXP01EGFCD.51.26.C04.1.454.CMB.2.raw
  modified_base (177)..(177): a, c, t, g, unknown or other
  modified_base (225)..(225): a, c, t, g, unknown or other
  modified_base (251)..(251): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtcccgtgtccccaggacagacagccaccatcacctgctctgganataagttgggtctaagtatgtttcgnggtatcaacatcacccaggcccggtcccgatactgcctcctctatcatgatcgcaacgccgccctcgacgggactccctgacgtcgacttctcgtggcctccaaactcgtcgggggaccacgacgccactcgtacgacccacgtccgccgggacccgaggcctggtacggtagtggaggtcgtagtaacttaacgtttacctggggtacgtaggggtaggttacgggggaacgaaggggggcggtcgtacgggtacggttacgggttacgggaccgggtacgggtaaccgtacggttccggtaccggttaccggtacggtacggttaccgaccggacccggaacggtcccgtcccgtccccgtccggttacctcccgttcccgttcccg

SEQ ID NO: 374856 - DNA, 597 bp, Homo sapiens
  misc_feature: GZ8MTXP01A3R36.51.26.C04.1.454.CMB.2.raw
  modified_base (258)..(258): a, c, t, g, unknown or other
  modified_base (281)..(281): a, c, t, g, unknown or other
  modified_base (398)..(398): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcgaggggctggagtgggtgctgttatacttntgatggaggtacaacatattacncagacgccgtgaggggccgattcaccatctccagagacaattccgggaacacactgtctctgacaaatcgaacagcctgagaagctgaggacagggcttgtttatactgtgtgcgtntccgactcacgtcgggtacggggtacgttaccttccgtccgacgtaacggtagtcgggtacgtcgtcggggaccgaagggaccgacggtccaccgtctccttacgccctccaaccgacgggcccacgtcccggtcccttcccccgttcggccctaacccctccctcccgaacgccgacctaacccgttcggtccggggg

SEQ ID NO: 374857 - DNA, 644 bp, Homo sapiens
  misc_feature: GZ8MTXP01ANA6R.51.26.C04.1.454.CMB.2.raw
  modified_base (177)..(177): a, c, t, g, unknown or other
  modified_base (464)..(464): a, c, t, g, unknown or other
  modified_base (512)..(512): a, c, t, g, unknown or other
  modified_base (539)..(539): a, c, t, g, unknown or other
  modified_base (549)..(549): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtccgtgtccccaggacagacagccacatcacctgctcgtggatattaagtttggggtacttaagtattggtttcgtggttatcaacatcaccccgaggcccgtccccgatacctgcctcctctatcatgatcgaccgaagcccggtccctcggacggggtaccttccccgtggaacggtcgtaacctttccgtcgtcgggtaccctacccgtaaaaccgttcgggtaacgggggaactacgacgtcccacttcgacgacccacgtcccggaccggtaacccgngggccgttggtaggtagtacggacggtcctagtaaccttatttacggngggttacgaggggtccggtagggacgnggggagtcgngtcgtaggttccgggcggtaggaacctggttccgtacgccgtcgtcggttcgcgacccgaagccgtccgccccgtgttcctaaccgttctccccg

SEQ ID NO: 374858 - DNA, 661 bp, Homo sapiens
  misc_feature: GZ8MTXP01EYJX0.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataagttggggtctaagtatgtttcgtggtatcaacatcacccaggccggtcccgatactgctcctctatcatgatgccagccggccctgacgggactccctgacgcgtacttctcgtggcctacccgaaacttcgtcgggggaccacgacgcccaactctacgacccacgtcccggcgggaccccgagggcctggtggatggaacggctagacttagttactggtcgtaggggtaggtgggacgaggggacggtcgtaggaccggttaggttttaccggggcggggtaacggggtaacccgtaagggttccggtaccgggttaacccggttccggttaacggggttacccgttacgggacccccgtaaacggggtccccgttcccggtcccccccggttcggggttaccctaacccgtttccccgtttcccccggg

SEQ ID NO: 374859 - DNA, 625 bp, Homo sapiens
  misc_feature: GZ8MTXP01A5ZGG.51.26.C04.1.454.CMB.2.raw
  modified_base (264)..(264): a, c, t, g, unknown or other
  modified_base (287)..(287): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgaactaacttttaatatgcacgtgggtgcgccgggctccgaggcgaaggggctggagtgggtgctgttatacttntgatggaggtacaacatattacncagacgccgtggacggggccattcaccatctccagacacaattccgggaacacactgtctctgacaaatcgaacagcctgagaagctggagacgagggtcttagtttatacgtgtgtagcgtactccgacctcgtacgtgggtaaccggggtactttaccgttcccgacgtaccgtaacggtggtcgggacggttcgacggggaccaacgggaccacggtccgacccgttcctaccgttaccgccctaacccgtaacgacgggtccccttagtcccgtcccttccccgcggccctaaccccgtcctaaccaacgcgccctaaccgttcggaaccgggg

SEQ ID NO: 374860 - DNA, 720 bp, Homo sapiens
  misc_feature: GZ8MTXP01D4KJ7.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccggaggacagacagccaccatcacctgctctggagtataagtttggggtactaagtattgtttcgtggtatcaacatcacccaggcccgtcccgatactgcctcctctatcatgatcgaccaacggccggccctcgacgggactcccgtgacgcgtacttctctcggcctacccaaactcgtcggggacacgacgccctacgtctacgacccacgtcccggaccgggaccccgagggccgtgggtacgggattgggaacgggtcttacggtaacttaacgtttacgttacgggggttacgaacgggggtcgggttacgggggaaccggtaaggggggacgggtcgttacggggcggtttaacgggttttccggggcggggtaacggggtaaccctaacgggttcccgtacggttaacccggttaccgtaaacggggttcccgaccgggaccccggtaaacgggtccccgttcccgggtccccccccgttacggggttccccttaacccgtttccccgttttccccccgg

SEQ ID NO: 374861 - DNA, 628 bp, Homo sapiens
  misc_feature: GZ8MTXP01CSPS9.51.26.C04.1.454.CMB.2.raw
  modified_base (218)..(218): a, c, t, g, unknown or other
  modified_base (264)..(264): a, c, t, g, unknown or other
  modified_base (285)..(285): a, c, t, g, unknown or other
  modified_base (310)..(310): a, c, t, g, unknown or other
  modified_base (315)..(315): a, c, t, g, unknown or other
  modified_base (626)..(626): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcacctttcgaactaaacttttaatatgcacgtgggtncgccggctccgaggcaaggggctggagtgggtgctgttataacttngatggagtacaacatattacncagacgccgtgagggcatcacatcncaganacaagtccggaacacactgtctctagacaaatcgaacagctagagaagctgaggacagggtcttagtttatacgtgtgtcgcgtacttccgactcaaaccggttggggttaaccgggggtactttaacccgttccgtaccggtacgtaaaccgggttaaggtcgggtaacggttcggtacgggggaccaaacgggacccgtacggtaccacccgtctcccgttacgccctaacccgaacgaacgggtcccacgtccggttccccttccccgcggcccaacccctcctccaagccgttaccctccgttcggngg

SEQ ID NO: 374862 - DNA, 568 bp, Homo sapiens
  misc_feature: GZ8MTXP01E1M02.51.26.C04.1.454.CMB.2.raw
  modified_base (257)..(257): a, c, t, g, unknown or other
  modified_base (280)..(280): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcgaggggctggagtgggtgctgttatacttntgatggaggtacaacatattacncagacgccgtgaggggccgattcaccatctccagagacaattccgggaacacactgtctctgcaaatcgaacagcctgagaagctgaggacagggctgtttatactgtgtgcgatccgacctcactgggtacgggagttacttccctccgcaacggtagtggacgtcgtggggccaacgggccacggtccaccgtctccttacgcctccaccaagggccccagtccggtccttcccccgttggccctaacccctccctcccaacgacgcctaacccgttcgtcggggg

SEQ ID NO: 374863 - DNA, 531 bp, Homo sapiens
  misc_feature: GZ8MTXP01B57KQ.51.26.C04.1.454.CMB.2.raw
  modified_base (395)..(395): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgacttctctggctcccaaaactctcgggggacacagccactctcgaccatccgcggaccaggctgngatgagctgactattacgtggtcgaggcgtgggacaggggagcgtagcgtagtttcggcgggagggtccagttctcgaccgtccgtaggttcgcgcccgaaggctcggccccgtcgttccgtaaccttcgttcccg

SEQ ID NO: 374864 - DNA, 576 bp, Homo sapiens
  misc_feature: GZ8MTXP01AOG1M.51.26.C04.1.454.CMB.2.raw
  modified_base (223)..(223): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctgganataagtttggggtctaagtatgtttcgtggtatcaacatcacccaggccggtccccgatactgctctctatcatgatgccaagccggccctgaggggactccctggacgcgtacttctctggcctccaaactcgtggggacacgagcccactctcgaccacgtcccgcgggacccaggctggtggatggaggctagactattacgtgggtctaggggcgtggggaccgaggggtagcgtggcgtcggttttacggggcgggtaggggaacctacggttcgtcgttaaccggtccgtaggttccgacgcccgaacggcctccggccccttcgggcctaaccgttccgttccccg

SEQ ID NO: 374865 - DNA, 580 bp, Homo sapiens
  misc_feature: GZ8MTXP01B6WPM.51.26.C04.1.454.CMB.2.raw
  modified_base (283)..(283): a, c, t, g, unknown or other
  modified_base (561)..(561): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggggctggtccagcctgggaggtccctcagactctcctgtgcagcctctggcttcaccttcgacaacttttaatatgcactgggtgcgccgggctccaggcaaggggctggagtggggtggctgttataacttctgatgggagtacaacatattacncagacgccgtgaggggccattcaccatctccagagacaattccgggaacacactgtctctgacaaatgaaccagctgagagctgaaggacagggcttgtttattactggtgtgcgatccgactcacgtagggtacggggtacgttacgttccgtccgacgaacggtagtggggacgtcggtcggggaccgaacggaccgcggtcaccgtctcctacgcctccaaccgaacggccctacgttccggtcctccccgttcggccaccctcctccaacgacncgacctcgttcggggaacc

SEQ ID NO: 374866 - DNA, 633 bp, Homo sapiens
  misc_feature: GZ8MTXP01CNHRC.51.26.C04.1.454.CMB.2.raw
  modified_base (224)..(224): a, c, t, g, unknown or other
  modified_base (530)..(530): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctgganattaagtttggggtactaagttatgtttcgtggtatcaacatcaccccaggcccgtccccgatactgctcctctatcatgatcgaccaagccggaccctcgagggactcccgtgacgtcgtacttctcgtggcctcccaaaccgttcgtcgggggactacgacgtcccactctcgacccacgtcccggaccgggacccgaggccgtggtacgggagttaggacgggtctaggacttattacgtcgggtacgaaggggtaggtaggggaacgtagggggaggtccgtggtcgtagggttttccgggnggggacgggaacccgtaggttccgtacgccggtccgtaggttccgcggacccgaacggtcctcccggtccccgtcggttacccgtcgttcccgtttaaccccg

SEQ ID NO: 374867 - DNA, 577 bp, Homo sapiens
  misc_feature: GZ8MTXP01D8XM3.51.26.C04.1.454.CMB.2.raw
  modified_base (260)..(260): a, c, t, g, unknown or other
  modified_base (282)..(282): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccgaggcaaggggctggagtgggtgctgttataacttntgatggagtacaacatattacncagacgccgtgaggggccattcaccatctccagacgacaagttccgggaacacactgtactctgacaaatcgaacagcctgagaagctggaggacagggtcttagtttatacgtgtgtgcgactccgactcacgtggtacgggtattacttccgtcgacaacggtgtggacgtcgtcggggaccagggccacggtcaccgtctctacgccctcacgacgggcccttacgtccggtccttccccgttggccctaacccgtcctaaccaacgcgacctaacccgttcggtccggggg

SEQ ID NO: 374868 - DNA, 624 bp, Homo sapiens
  misc_feature: GZ8MTXP01EQ9G3.51.26.C04.1.454.CMB.2.raw
  modified_base (201)..(201): a, c, t, g, unknown or other
  modified_base (257)..(257): a, c, t, g, unknown or other
  modified_base (277)..(277): a, c, t, g, unknown or other
  modified_base (463)..(463): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaanatgcactgggtgcgccggctccaggcaaggggctggagtgggtgctgttatacttngatggagtacaacatatacncagacgccgtgaggggcatcacatctccagagacaagttccgggaacacactgtctcgtgacaaatcgaacagcctagagaagcgtgacggacgagggtcttagttttatacgtgtgtgcgatccgactcacgttcgggtacggtagttacctccgtacgacgtaacggtaggtcggtacgttcgnggggacccgaacgggacccgtacggtccgtaccggttcctacccgtttacgccccgtaacccgaaccgaacggggtccccacgttcccggttcccttcccccgttggcccctaaccccgtcccgtaaccaacggcacccgtaacccgttcgggaaccgggg

SEQ ID NO: 374869 - DNA, 602 bp, Homo sapiens
  misc_feature: GZ8MTXP01DHXEA.51.26.C04.1.454.CMB.2.raw
  modified_base (259)..(259): a, c, t, g, unknown or other
  modified_base (281)..(281): a, c, t, g, unknown or other
  modified_base (371)..(371): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactggggtgcgccgggctccaggcaaggggctggagtgggtgctgttataactntgatggaggtacaacatatacncagacgccgtgaggggccattcaccatctccagagacaattccgggaacacactgtctctgacaaatcgaacagcctgagaagctgaganagggctgtttatactgtgtgcggatccgactcacgtgggtacgggattacgttcctaccgcaaacggttagtcgggaacgttcgagggggacccaaaggggacccacgggtaccaacccgttctacccttacgccctccaaccgaacggggccccttaagtcccgggttcccttcccccgttggccccaacccttccctccgaaagcgcctaacccgttcgtaaccggggg

SEQ ID NO: 374870 - DNA, 748 bp, Homo sapiens
  misc_feature: GZ8MTXP01BU2W2.51.26.C04.1.454.CMB.2.raw
  modified_base (177)..(177): a, c, t, g, unknown or other
  modified_base (225)..(225): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtcccgtgtccccaggacagacagccaccatcacctgctctgganattaagtttggggtactaagtattgtttcgtggtatcaacatcacccaggcccggtccccgatactgcctcctctatcatgatcgaccaacggccggccctcgacgggacttcccgtgacgtcgtactttctcgtcggccctacccgtaaaaccgttccgtcgggggaacccaaccgacgtccccgtaacttccgtacgacccctaccgtccccgggacccgggggaaccccagggtccgttgggtacgggaacgttcgggaacgggtccgttacgtaaccgtttaacgtttaacccgttgggggtacccggtagggggtcccgggttagggggaaccggaacgggggtcggtcgttacgggtcggttaacggttttccgggggaccggggtaacggggtaaccctaagggttcccgtaccggttacccggttacccggtaacgggttccgaaccggaccccggtaacgggtcccgttcccgggccccccttcgggttcccctaaccgttcccgtttcccccg

SEQ ID NO: 374871 - DNA, 652 bp, Homo sapiens
  misc_feature: GZ8MTXP01B66T3.51.26.C04.1.454.CMB.2.raw
  modified_base (263)..(263): a, c, t, g, unknown or other
  modified_base (283)..(283): a, c, t, g, unknown or other
  modified_base (305)..(305): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaactttaatatgcacgtgggtgccgccgggctccgaggcgaaggggctggaggtgggtgctgttatacttngatggagtacaacatatacncagacgcgtgacgggcatcacntctcagacgacaagttaccggacacactgtctctgacaaatcgaacagctagagaacgcgtggaaggacgaggggtctttagttttaacttacgtggtgttcgacgtactcccggaaccttcgtaacggttcggggtaacggggtactttaccttccgtaccgacgtaacggtaggtcggacggttcggtacgggggaccaacggggaccgacggtcctaccgtccttccgttacgccctaaccgaaccggaccgggtcccacggttcccggtccctttcccccggcgttacccctaacccctcccgtaaccgaacggcgttacccgtaaccgttcgggaaccgggg

SEQ ID NO: 374872 - DNA, 537 bp, Homo sapiens
  misc_feature: GZ8MTXP01DM3QW.51.26.C04.1.454.CMB.2.raw
  modified_base (412)..(412): a, c, t, g, unknown or other
  modified_base (422)..(422): a, c, t, g, unknown or other
  modified_base (439)..(439): a, c, t, g, unknown or other
  modified_base (465)..(465): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagataatttggggtctaagtatgtttcgtggtatcaacatcacccaggccggtccccgatactgctcctctatcatgatgccaagcggccctcgacgggactcccctgacgcgacttctctggcctccaaaactctggggacacgacgccactctcgacccatcccgcgggacccaggctgtggatgagcngactattacnggtcaggcgtgggacgngggaggctggcgtagtttcgggcggnggggaaccagttctggaccgtcgtaaggcgacggaccaaggcctcgcccctggttcctaacgttcgttcccg

SEQ ID NO: 374873 - DNA, 677 bp, Homo sapiens
  misc_feature: GZ8MTXP01AM73C.51.26.C04.1.454.CMB.2.raw
  modified_base (261)..(261): a, c, t, g, unknown or other
  modified_base (283)..(283): a, c, t, g, unknown or other
  modified_base (327)..(327): a, c, t, g, unknown or other
tcagcgatcgtatacacgaccggtgctcgatttagtctagcgactttgggtttgggctgagctgggttttcctcgttgctcttttaagaggtgtccagtgtcaggtgcacttggtggagtctggggggaggcgtggtccagcctgggaggtccctcagactctcctgtgcagcctctggcttcaccttcgacaactttaatatgcacgtgggtgcgccgggctccaggcaaggggctgggagtgggtgctgtataacttcngatggaggtacaacatattacncagacgccgtgagggccattcacatctcagagacaatccggganacactgtctctgacaaatcgaacagcctagagaagctgagggacgtagggcttgtttatacttgtgttcgacgtactcccgacctcgtaacgttggggtaccgggggtactttaacccttccgtaccggacgtaacgggttaggtcggtaacggttcggtacgggggacccgaaggggacccgtaccggtacctaacccggtccttacccgttaaccggccccttaacccaacccggaaaccgggggtccccttaacggttcccgggtcccctttccccccggttcggcccctaacccccgtccctaacccgaaacggaccggttccctaaccggttccggtccgggggg

SEQ ID NO: 374874 - DNA, 598 bp, Homo sapiens
  misc_feature: GZ8MTXP01CM2WW.51.26.C04.1.454.CMB.2.raw
  modified_base (257)..(257): a, c, t, g, unknown or other
  modified_base (279)..(279): a, c, t, g, unknown or other
  modified_base (549)..(549): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttatacttngatggaggtacaacatattacncagacgccgtgagggccattcaccatcctcagagacaattccgggaacacactgtctctgcaaatcgaaacagcctgagaagctgaggacgagggtctgtttattactgtgtgcgatccgaccttcgacgtgggtacgggactttacctcctcgacgtaacggtagtcgggtaacgtcgtacgggggaccgaagggacccgacggtcaccggtccttccgttaacgccctaaccgaccaacggggcccagttcccggtccttacccccgngccccgtaacccctccgtccaaaggtcgcctaacccgttcgtaacgggg

SEQ ID NO: 374875 - DNA, 651 bp, Homo sapiens
  misc_feature: GZ8MTXP01AINXM.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagtattaagtttggggtactaagtattgtttcgtggtatcaacatcacccaggcccggtcccgatactgctcctctatcatgatcgccaagccggccctcgaggggactcccgtgacgcgtacttctctggcctccaaactcgtggggacacgacgcccactctacgacccacgtcccggaccgggacccagggtcctggtacgggagtggacgggctagtaacttatttacgtggggttacgaggggtcgggttaggggaccgaggggacggcgtggcggttagttttaccggggcggggaacggggtaaccgtaggttccgtacggttacccgggttaccggttacgggttccgacgggccccgaaacggggtcccgtaacccggtccccccgttcggggttccctaacccgttcccgtttcccccgg

SEQ ID NO: 374876 - DNA, 729 bp, Homo sapiens
  misc_feature: GZ8MTXP01DXWXF.51.26.C04.1.454.CMB.2.raw
  modified_base (257)..(257): a, c, t, g, unknown or other
  modified_base (268)..(268): a, c, t, g, unknown or other
  modified_base (274)..(274): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtggtgctgttatacttngatgagtacanatatancagacgcgtgagggcattcacatctccagagaacaattccgggaaacacgtaactgtcttctagacaaatcgaaacagcctagagaacgctggagacgagggtcttaggtttacttacgtgttgtgacgtactaccgaccttacgaacgttcgggttaaacgggggtactttaacccttccgtacccggtaacgtaaaccgggttaggttacggggtaacgttcggtaccgggggaaccctaaaccgggggaccctaacggggttacccctaacccggttccgtaccctttaaacgcccccgttaacccgaaacccggaaacgggggtcccccttaaacggttccccgggttacccctttccccccggttgggacccccctaaacccccggtttccctaacccccgaaaaggaacccggttacccaaaccccggttttccgggtaacccgggggg

SEQ ID NO: 374877 - DNA, 649 bp, Homo sapiens
  misc_feature: GZ8MTXP01AKNO0.51.26.C04.1.454.CMB.2.raw
  modified_base (177)..(177): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggactccctggccgcctatgacctgactcagccacctnagtgtccgtgtccccaggacagacagccacatcacctgctctggatattaagttggggtactaagtattgtttcgtggtatcaacatcacccgaggccggtcccgatactcgctcctctatcatgatcgaccaacgccggtccctcgacgggtactcccgtagacgtcgtacttctcgtcggcctaccgaaactcgtggggaacacgacgaccctactcacgaccctacgtcccggaccgggaccgacgggtcttggtaggagtacggacggtcctaggtaacttagttacgtcggggtacgaaggggtccggtaggggacgagggggacggtcgtacggtcgttaacgggtttcggggacgggacggggtaacgtaacggttcgtaccggaccgttccgttacgggttccacggccccgaacgggtccctcccgtcccccgttcggttaccctcccgttcgtttcccccgg

SEQ ID NO: 374878 - DNA, 625 bp, Homo sapiens
  misc_feature: GZ8MTXP01AZ2V1.51.26.C04.1.454.CMB.2.raw
  modified_base (283)..(283): a, c, t, g, unknown or other
  modified_base (573)..(573): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcacgtgggtgcgccgggctccgaggcaaggggctggagtgggtgctgttataacttctgatggaggtacaacatattacncagacgccgtgaggggccgattcaccatctccagagacaattccgggaacacgactgtctctgcaaatcgaacagcctgagaagctgaggacagggcttgtttattactgtgtgcgactccgacctcgaacgtgggtacgggtacgttaccttccgtaccgacgtaaccggtagtgggaaccgttcgcgggggacccaacggggaccctacgggtcctaacccggtcttacccgttacggccctcccaaccgaaacggggtccccaagttcccgggtccctttcccccgnggcccctaaccccctctaacccgaaaggcccgccgtaaccgttcgggtcggg

SEQ ID NO: 374879 - DNA, 616 bp, Homo sapiens
  misc_feature: GZ8MTXP01AWQX7.51.26.C04.1.454.CMB.2.raw
  modified_base (260)..(260): a, c, t, g, unknown or other
  modified_base (281)..(281): a, c, t, g, unknown or other
  modified_base (330)..(330): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttcngatggaggtacaacatatacncagacgccgtgagggccgattcaccatctccagagacaattccgggaanacactgtctctgcaaatcgaacagcctgagaagctgaggacagggcttgtttatactgtgtgcgatccgacctcacgtgggtacggggtagttaccgttcctccggaccaacgggtacgtcgggaaccggtcgtacgggggccgaaacggggcccgaacgggtcctaacccggtcctcccgtagccctcccaacccgaaacgggcccaacgtccgggttcccttcccccgttgggccccaaccccgtccctaacccaacggacgccgtaacccgttcgtccggggg

SEQ ID NO: 374880 - DNA, 914 bp, Homo sapiens
  misc_feature: GZ8MTXP01AZ7YG.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagtattaagtttggggtacttaaggtattggttttcgtggtatcaacatcacccgaggcccggtccccgatacctgcctcctctatcatgactgaccaaggccggccctcgacgggactcccgtagacgtccgtactttccgtcgtcgggtccttacccgtaaaaccgttccgggttaacggggggaacccaaaccggaacccgggtaccccctaaacccggtttcccgttaccgggaaacccccgtaccggttacccccggggacccgggggaacccccgtacgggggtcccgttaggggttacgggggtaacgttacggggaacggggtaccgttacgggtaaacctttaacgtttaaccggttcgggggttaccgggtaacggggggtacccggggtttaacggggggaacccgggtaacgggggggaccggggtccggttacgggggtacccggggttaaccgggggttttttcccggggggaacccggggggttaacgggggtaaccccggttaacggggttccccgggttacccgggttaacccccggggtttacccggttaaccgggggttcccgttaacccggggaacccccgggtaaccggggtccccgttaacccccgggtacccccccgggttcccgggggttaccccgttaaccccgtttccccggttttaacccccccgg

SEQ ID NO: 374881 - DNA, 603 bp, Homo sapiens
  misc_feature: GZ8MTXP01EVYRF.51.26.C04.1.454.CMB.2.raw
  modified_base (200)..(200): a, c, t, g, unknown or other
  modified_base (260)..(260): a, c, t, g, unknown or other
tcagcgatcgtatacacgaccggtgctcgatttagtctagcgactttgggtttgggctgagctgggttttcctcgttgctcttttaagaggtgtccagtgtcagatgcacctggtggagtctgggggaggcgtggtccagcctgggaggtccctcagactctcctgtgcagcctctggcttcaccttcgacaactttaanatgcactggggtgcgccgggctccgaggcaaggggctggagtgggtgctgttataacttntgatggagtacaacatatactcagacgccgtgagggccgattcacatctccagagacaattccggaacacactgtctctgacaaatgaaacagcctgaagagcgtgaaggacaggggtcttgtttattactgtagtgcgactccgactacacgttaggtacgggtattactccgtaccgacaacggggtagtagggacgtcgtcggggccgaacgggaccaaccggtcctaccggtctccgttaacgccctaccgaccgaacgggcccctaacgttcccggttccttcccccgttcggcccctacccctccccgtaccgaacgacgccgttaacccgtccggg

SEQ ID NO: 374882 - DNA, 668 bp, Homo sapiens
  misc_feature: GZ8MTXP01CWGOD.51.26.C04.1.454.CMB.2.raw
  modified_base (223)..(223): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtcgtccccaggacagacagccacatcactgctctgganatagttgggtctaagttatgtttcgtggtatcaacatcaccgaggccgtcccatactgccttctctagtcatgatcgacaaggccgccctcgacgggtctacccgtgacgccgtacttccgtcgtcgtcctacccaaacgttccgtcgggggaaccaccgacgacctactcgtacgaaccgtacgtcccggaccgggacccgaggtccgtggtcggacgttagggacgggtctagtactttacgttacgttacgggttcggaacggggtcgggtacgggggacgacgggggtacggtcgtacgggtcggttaacggtttcggggacgggtaacgggtcccgtggttaccggttcggacccgttaccggtacgttcccggacgttcccgtaaacggtcccgttcccggtccccgtaccggttacctaaccgttccggtttcccccg

SEQ ID NO: 374883 - DNA, 555 bp, Homo sapiens
  misc_feature: GZ8MTXP01AYOTR.51.26.C04.1.454.CMB.2.raw
  modified_base (224)..(224): a, c, t, g, unknown or other
  modified_base (410)..(410): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctgganataagtttggggtctaagtatgtttcgtggtatcaacatcacccagccggtcccgatactgctctctatcatgatcgccaagccggccctcgacgggactcccgtgagcgtacttctctggctacccaaactcgtggggacacgagccactctgaccagtccgcggaccaggcgtgtggatgacgntgactattacgtggtcgaggccggtagggaccgagggggcgcgtcggtcgtaggttcgggacgggcggaacgtcgttccgtcggaccgtcgtacgcgccggacccgtaacgcccgtccgccccgtacgttcctccgttcgtcccg

SEQ ID NO: 374884 - DNA, 614 bp, Homo sapiens
  misc_feature: GZ8MTXP01ES07G.51.26.C04.1.454.CMB.2.raw
  modified_base (259)..(259): a, c, t, g, unknown or other
  modified_base (281)..(281): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttntgatggaggtacaacatatacncagacgccgtgaggggccgattcaccatctccagagacaattccgggaacacactgtctctgacaaatcgaacagcctgagagctgaggacagggcttagtttatactgtgtgcgactccgacctcgacgtgggtacgggagttacttccgtccgtacgaacggtacggtggacggtcgtcggggccgaaacgggccgacggtcctaccggtcctcccgttacggccctccgaacccgaacgggccccttaacgtcccgggttcccttccccccgttcgggccctaacccctcccgtaacccgaacgacgacctaacccgttcggtccggggg

SEQ ID NO: 374885 - DNA, 626 bp, Homo sapiens
  misc_feature: GZ8MTXP01DAKSP.51.26.C04.1.454.CMB.2.raw
  modified_base (260)..(260): a, c, t, g, unknown or other
  modified_base (282)..(282): a, c, t, g, unknown or other
  modified_base (443)..(443): a, c, t, g, unknown or other
  modified_base (571)..(571): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaacttttaatatgcactgggtgcgccgggctccaggcaaggggctggagtgggtgctgttataacttntgatggagtacaacatattacncagacgccgtgagggccattcacatctccagagacaattccgggaacacactgtctctagacaaaatcgaaacagcctgaagaacgcgtgaagggacaggggtctaggtttatacgtgtgtgcgactccgacctcgacgtgggtacgggtattccgttccnccgacgaaccggtagtcgggacgtcggtaggggcccgaaacgggaccgacggtaccgacccgttcctacccgttacgccctaacccgaacgaaaccggggcccacgttcccggtccctttccccccgnggttcccaaccccttacctcccgaaggtaccgctaaccccgttcgtaaccggggg

SEQ ID NO: 374886 - DNA, 531 bp, Homo sapiens
  misc_feature: GZ8MTXP01E4TL2.51.26.C04.1.454.CMB.2.raw
  modified_base (290)..(290): a, c, t, g, unknown or other
  modified_base (357)..(357): a, c, t, g, unknown or other
  modified_base (439)..(439): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcactgctctgagataagtttggggtctaagtatgtttcgtggtatcaacatcacccaggcccggtcccgatactgctcctntatcatgatgcaagcggcctcgagggactccctggacgcgacttctcgtcggctcccaaaacttcgnggggacaacacgccactctcgaccactccgacggaccgagctgtgatgagctgactatatggtcagggcgtgggacaggggnggacgtgcgtagtttcgggcggagggaacacgttgtcgacgtcgtaggttcgcgccgaaggcctcgcccctcggttctaacgttcgttcccg

SEQ ID NO: 374887 - DNA, 651 bp, Homo sapiens
  misc_feature: GZ8MTXP01C07X8.51.26.C04.1.454.CMB.2.raw
  modified_base (258)..(258): a, c, t, g, unknown or other
  modified_base (279)..(279): a, c, t, g, unknown or other
  modified_base (364)..(364): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttataacttntgatggagtacaacatatacnagacgcgtgagggccattcaccatctccagagacaacgttccgggaacacactgtctctgacaaatcgaacagcctagagaacgntggaggacgagggtcttagtttattacgtgtgtcgacgtactccgtacctacgacggttcggggtaacggggtacttaccttccgtaccggacgtaaccgggtagtcgggtacggtcggtcgggggaccgaaacggggcccgtacggtaccgacccgttccttaccgtacgcccctaaccgaacccgttacgggtccccacgttcccgggtccccttacccccgttggcccctaaccccgtcctaacccgaaacggtccgacctaacccgttccgggtaaccggggg

SEQ ID NO: 374888 - DNA, 673 bp, Homo sapiens
  misc_feature: GZ8MTXP01CJ838.51.26.C04.1.454.CMB.2.raw
  modified_base (177)..(177): a, c, t, g, unknown or other
  modified_base (220)..(220): a, c, t, g, unknown or other
  modified_base (224)..(224): a, c, t, g, unknown or other
  modified_base (341)..(341): a, c, t, g, unknown or other
  modified_base (589)..(589): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtccgtgtccccaggacagacagccacatcacctgctcgngganattaagttgggtctaagtattggtttcgtggtatcaactactcacccgacggcccggtacccgatacctcgccttcctctatcatgatcgccgaagccggccctgacgggactccgngacgcgtacttctcgtggtcctaccgtaaacgtcgtaacggggaccaaccgtacggaccctacgttacccgcgaaacccgtacgtcccgggaacccgggacccgtacggggtccttacggggtaggtaacgtgggtacgggtaccttagtaaccttaaagttacgttacggggtcggtaaggggtcgggtacggggacgtagggggacgtcgtaggtcggttacggttcggggacgggaggtaaccgngttcgtacggttccgtacgtggttccgccggacccgaaggtcccgtaaccggtccccgtggttcctaaccgttccgttccccgg

SEQ ID NO: 374889 - DNA, 583 bp, Homo sapiens
  misc_feature: GZ8MTXP01BGERG.51.26.C04.1.454.CMB.2.raw
  modified_base (225)..(225): a, c, t, g, unknown or other
  modified_base (417)..(417): a, c, t, g, unknown or other
  modified_base (437)..(437): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtcccgtgtccccaggacagacagccaccatcacctgctctgganataagtttggggtactaagtatgtttcgtggtatcaacatcacccaggcccggtcccgatactgcctcctctatcatgatcgccaagccggcccctcgacgggacttccccgtgacgcgtacttctcgtcggctcccaaacgtcgtggggacacacgccactctcgacccacgtccgcgggaccaggctggnggatgagctgactattacgngtcgagggcggtgggacgaggggcgtgtacgtcgtaggttttcgggcgggtagggaaccaggttccgtcggttccgtccgtacggttccgcggccccggaaggtcccgtccggtcccccgtcgggttacctcccgttctttccccg

SEQ ID NO: 374890 - DNA, 677 bp, Homo sapiens
  misc_feature: GZ8MTXP01DTMRL.51.26.C04.1.454.CMB.2.raw
  modified_base (177)..(177): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtccgtcgtcccaggacagacagccacatcactgctctggatattaagtttggggtacttaagtattgtttcgtggtatcaacatccacccgacggcccggtccccgatactcgcctcctctatcactgactcgaccaaggccggaccctcgacgggactcccgtgacgctacttctcgtcgtcctccaaacgtcggtcgggacacgacgcctactctacgaccacgtccggaccggacccaggtcgtaggtacggagttacggacgggtcttacggtactttaacgttaccggtacggggttacggacggggtaccgggtaggggaaccgggagggggtcggtcgtacggggtaccgtttacgggtttccggggaaccgggtcggggtaaaccgttcggttccgtaccgggttaccgttaccggttacggacccggacgcccgtaacgggtcctcccggtccccgtacgggttaccctccgttcccgtttccccgg

SEQ ID NO: 374891 - DNA, 548 bp, Homo sapiens
  misc_feature: GZ8MTXP01AXMEY.51.26.C04.1.454.CMB.2.raw
  modified_base (225)..(225): a, c, t, g, unknown or other
  modified_base (429)..(429): a, c, t, g, unknown or other
  modified_base (433)..(433): a, c, t, g, unknown or other
  modified_base (454)..(454): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatcccctggccgcctatgacctgactcagccaccctcagtgtccgtgtccccaggacagacagccaccatcacctgctctgganataatttgggctaagtatgtttcgtggtatcaacatcaccccaggccggtccccgatactgctctctatcatgatgaccaagcggcccctcgacggggactccccgtgacgcgtacttcgtctggcctacccaaacgttcgtggggacacacgccactctcgacccatcccggcggacccaggctggtggactgaggctgactntacnggtcgaggcgtgggacagggngcgtagcgtagttcggcggtaggaacagttcgtggacccgtcgtgcgcgcccgaagtccgtccgcccctcgggttacctcgttcccgttaaccg

SEQ ID NO: 374892 - DNA, 627 bp, Homo sapiens
  misc_feature: GZ8MTXP01CLG2V.51.26.C04.1.454.CMB.2.raw
  modified_base (204)..(204): a, c, t, g, unknown or other
  modified_base (263)..(263): a, c, t, g, unknown or other
  modified_base (283)..(283): a, c, t, g, unknown or other
  modified_base (450)..(450): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgaactaacttttaanatgcacgtgggtgcgccggctccgaggcgaaggggctgggagtgggtgctgttatactngatggagtacaacatatacncagacgccgtggacgggcatcacatctccagagactaagtccgggaacacactgtctctagacaaatcgaacagcctagagaagcgtgaggacgaggggtcttgtttacttacgtgtgtgcgtactccgacttcgacggttacggggtacggggtacttccgttccncggacgtaacgggtgtacgggacggttcggacggggaccgaacggggccctacggtcctaccgtccgtaccttacgccctaaccgaaccggaacgggccccacgttccggtcccttccccgcgttcccctaaccctccgtaaccgacgtaccgccgtaaccgttcggtaaccggggg

SEQ ID NO: 374893 - DNA, 609 bp, Homo sapiens
  misc_feature: GZ8MTXP01EVERT.51.26.C04.1.454.CMB.2.raw
  modified_base (279)..(279): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttataacttctgatggagtacaacatatacncagacgccgtgagggccgattcaccatctccagagacaattccgggaacacactgtctctgacaaatcgaacagcctgagaagctgaggacagggcttgtttattactgtgtgcgatccgacctcacgtgggttacgggtagttaccgttcctacggacgaaacgggtagtcgggtacggtcggtcggggacccgaaacggggaccctacgggtccacccggtctcccgttacgccctaaccgaacccaacggggccccttagtcccggttccttcccccgttcggccctaacccctcctaacccgagacgcctaaccgttcgtcggggg

SEQ ID NO: 374894 - DNA, 683 bp, Homo sapiens
  misc_feature: GZ8MTXP01DW4E4.51.26.C04.1.454.CMB.2.raw
  modified_base (419)..(419): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtcgtccgtgtccccaggacagacagccacatcacctgctctggagattaagtttggggtactaagtattgtttcgtggtatcaacatcacccacggccggtcccgatacctgcctcctctatcatgatcgccaacgccggccctcgacgggactcccgtgacgcgtacttctcgtcggcctacctaaacgtcgtcggggacacgacgccactctacgaccacgtccggaccggaacccgnggtaccgtggtacggtagttagggacggtacgttacgtaacgttaacgtttaaccgttggggtaccggtaacggggtcgggttaacgggggaacggtacgggggaacggtcggttacgggtccggttaacgggttttccggggaccgggggtacggggtaaccgtacggttaccgtcggttacccggttaccgtacgggttccgacgacccgtaacggtcccgtcccgtccccgtcggttacctaaccgttccgtttcccccgg

SEQ ID NO: 374895 - DNA, 631 bp, Homo sapiens
  misc_feature: GZ8MTXP01ATQX6.51.26.C04.1.454.CMB.2.raw
  modified_base (201)..(201): a, c, t, g, unknown or other
  modified_base (259)..(259): a, c, t, g, unknown or other
  modified_base (282)..(282): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaanatgcactgggtgcgccgggctccaggcaaggggctggagtgggtgctgttataacttntgatggaggtacaacatattacncagacgccgtggacggggccgattcaccatctccagagacaattccgggaacacactgtctctgacaaatcgaacagcctagagaacgctggagacgagggtcttgtttatactgtgtgcgacgtccgacctcacgtcgggtacgggtagttaccttccgtacgacgtaacggtagtcgggacgtcggtcggggaccgaaacgggacccgacggtacctacccggtccttacccgttacgccctaacccgaaccgaacggggccccacgttccggtcccttcccccgttcgggcccctaaccccgttcctaacccgaaacgcgacccgtaacccgttcgggtccggggg

SEQ ID NO: 374896 - DNA, 719 bp, Homo sapiens
  misc_feature: GZ8MTXP01BFLAT.51.26.C04.1.454.CMB.2.raw
  modified_base (177)..(177): a, c, t, g, unknown or other
  modified_base (223)..(223): a, c, t, g, unknown or other
  modified_base (292)..(292): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtccgtgtccccaggacagacagccacatcacctgctctgganataagttgggtctaagtattgtttcgtggtatcaacatcacccaggcccggtcccgatactgcctcctntatcatgatcgaccaaggccggccctagacggggtactccccgtggacgtcggtactttcctcgttcggacccttacccgtaaaaacgtccggttaacggggggaacctaacccgaacgggtacccctaaccgttacccgttacggaaacccctaacgttccccgggacccgggggaacccccaaggggtcccgttagggtttaccggggaacgttgggaacggggtacttacgggtaaactttaacgtttaacgtcggggttacgaggggtaccgggttggggaacccgagggggacggtccgtaggtaccggttacggtttcgggaccgggagggtaacctggttcgacgttacccgtcccgtaggttccgacgcccgaagggtccgtccgtaccccgtcggttctaaccttccggttaaccccg

SEQ ID NO: 374897 - DNA, 686 bp, Homo sapiens
  misc_feature: GZ8MTXP01EX01X.51.26.C04.1.454.CMB.2.raw
  modified_base (200)..(200): a, c, t, g, unknown or other
  modified_base (258)..(258): a, c, t, g, unknown or other
  modified_base (278)..(278): a, c, t, g, unknown or other
  modified_base (326)..(326): a, c, t, g, unknown or other
  modified_base (352)..(352): a, c, t, g, unknown or other
  modified_base (363)..(363): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggagcgtggtccagcctgggaggtccctcagactctcctgtgcagcctctggcttcaccttcgacaacttttaanatgcacgtgggtgcgccgggctccaggcaaggggctggagtgggtgctgttatacttngatggagtacacatattacncagacgccgtgagggccattcaccatctccagagacaattccgggaanaccactgtctctgacaaatcgaaacngcctagagaancgtgaggacagggcttgtttatacgtgtgtgcgtactccggacctcgacgttggggttacggggtactttaccgttacccgtccggtacgtaaccgggtacggttcgggtaaccgggttcggtacgggggacccaaagggggtacccctaccgggtaccgaaccccggtttcttaccccgtttaacgccccgttaacccgaaccggttaaaccggggtccccttaaacgttcccgggttaccctttcccccggttcgggacccgtaaccccctccctaaccgaaacggacggttacccctaacccggttccggtcccgggggg

SEQ ID NO: 374898 - DNA, 570 bp, Homo sapiens
  misc_feature: GZ8MTXP01AK8TB.51.26.C04.1.454.CMB.2.raw
  modified_base (244)..(244): a, c, t, g, unknown or other
  modified_base (252)..(252): a, c, t, g, unknown or other
  modified_base (262)..(262): a, c, t, g, unknown or other
  modified_base (326)..(326): a, c, t, g, unknown or other
  modified_base (339)..(339): a, c, t, g, unknown or other
  modified_base (366)..(366): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccacctcagtcgtccgtgtccccaggacagacagccaccatcacctgctctggagataagtttggggtctaagtntgtttcgnggtatcaacntcacccaggcccggtccccgatactgctctctatcatgatgccaagcggccctgacggctccgngacgcgtattccngtcggctcccgaaatcgtgggacacgngcccatctgacccacgtcccggccggacccgaggcctggtagagtggaggctgtacttagtctgggtacgagggcggtagggaccgagggcggcgtgggcgtagggtttccggacgggacgggaacctggttcgcggttaccgtcgtaaggttccgcgttaccgaacgggcctccggcccctcggttcctaacgttcccgtccg

SEQ ID NO: 374899 - DNA, 819 bp, Homo sapiens
  misc_feature: GZ8MTXP01DGI4M.51.26.C04.1.454.CMB.2.raw
  modified_base (270)..(270): a, c, t, g, unknown or other
  modified_base (295)..(295): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtcgtggggggaggcgtggtccagcctggggaggtccctcagactctcctgtgcagcctctggcttcaccttcgaactaaacttttaatatgcacgtgggtcgcgccgggctccgaggcgaaggggctgggagtgggtgctagttatacttnagagtaggagtacaactatattacncacgacgcgtggacggggcctatcaccatcctaccaagacgaactaacgttaccggaaacactacgtcgtctacgtagactaaagtacgaaacacgtaccgtagaaggaacgtcgtaagggaaacgggacgtaacggggtactttaggttttaacgtttacgttgggtcggttacgccgtaacgtaccccggtaaccttccggtaacgggttacgggggttaaccgggtactttaccgtcccgtacgaacgtaacggtacggggtacgggtacggtaccggtacgggggaacccgtaaaccgggtcccgtaccgggttaccctaccccggtttcctttaaccccgttaacccggtccccttaaaccccgggaaacccggaaacccgggggttccccccttaacggtttacccccgggtttcccccctttccccccggttcgggttaccccccttaacccccgttacccgtaacccgaaacgggacccgttacccgtaaccccgggtttcgggtaacccgggggg

SEQ ID NO: 374900 - DNA, 588 bp, Homo sapiens
  misc_feature: GZ8MTXP01B77O1.51.26.C04.1.454.CMB.2.raw
  modified_base (387)..(387): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccattcaccatctccagagacaattccgggaacacactgtctctgcaaatgaacagcctgagagctgagacagggctgtttatactgtntgcgatcgactcacgtggtacggggtattacttacctccgacaacggtagtcgggtacgtccgtggggaccaaacgggccgaacgggtccaccggttcctcccgtttacgcccttccgaaccaaacggggcccaacgtccggtccttcccccgttggcccaaccctccccgtccaacggacgcccaaccgttcgtcggggg

SEQ ID NO: 374901 - DNA, 617 bp, Homo sapiens
  misc_feature: GZ8MTXP01AX12R.51.26.C04.1.454.CMB.2.raw
  modified_base (259)..(259): a, c, t, g, unknown or other
  modified_base (281)..(281): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcacctttcgacaactttaatatgcactgggtgcgccgggctccaggcaaggggctggagtgggtgctgttatacttntgatggaggtacaacatatacncagacgccgtgagggccgattcacatctccagagacaattccgggaacacactgtactctgacaaatcgaacagcctagacgaagctgaggacgagggtcttagtttatactgtgtgcgactccgactcgacgtcgggtacggggtacttacgtccctccgacgtaacggtggtcggacggtcgtggggacccgaaaggggcccgtacggtccaaccggttcctaccgttaccgcctcccaaccgacggggtccccttacgtcccgggtcccttcccccgttcggttccccaaccccttcccaacccgaacgcgacctaaccgttcggtccggggg

SEQ ID NO: 374902 - DNA, 638 bp, Homo sapiens
  misc_feature: GZ8MTXP01BYEHC.51.26.C04.1.454.CMB.2.raw
  modified_base (200)..(200): a, c, t, g, unknown or other
  modified_base (258)..(258): a, c, t, g, unknown or other
  modified_base (278)..(278): a, c, t, g, unknown or other
  modified_base (313)..(313): a, c, t, g, unknown or other
  modified_base (337)..(337): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaanatgcacgtgggtgcgccgggctccaggcaaggggctggagtgggtgctgttatacttngatggagtacaacatatacncagacgccgtgagggccgattcaccatctccaganacaattccgggaacacactgtctntgacaaatcgaacagcctagagaagctggaggacgagggtcttgtttattacgtgtgtgcgtactccgacctcaacggttgggtacggggtacttacttccgtcgacaaccggttagtcggacgttcgcggggacccgaacgggaccctacggtcccgaaccgtcccttaccgtacgtccctcccaaccgttaaacggggccccaaggttcccgggtccctttccccccggcggacccctaacccccttccctaacccgaaaacggcccgttacccgtaaccccgttcgggtcccgggggg

SEQ ID NO: 374903 - DNA, 605 bp, Homo sapiens
  misc_feature: GZ8MTXP01B7JTK.51.26.C04.1.454.CMB.2.raw
  modified_base (260)..(260): a, c, t, g, unknown or other
  modified_base (283)..(283): a, c, t, g, unknown or other
  modified_base (412)..(412): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcacctttcgacaactttaatatgcactgggtgcgccgggctccaggcaaggggctggagtgggtggctgttataacttntgatggaggtacaacatattacncagacgccgtgaggggccgatcaccatctccagagacaattccgggaacacactgtctctgacaaatcgaacagcctggagaagctggaggacgaggggcttgtttattactgtgtgcgatccgacctnacgtgggtacgggattacctcctcgacgaacggtgtggacgtcggtcggggaccaacgggaccacggtcctacccggtctacccgttacgccctaacccgaacccgaacgggtccccacgtccggttccccttcccccgttcgggccctaacccctccctccaaacgcggcctaacccgttcggaaccggggg

SEQ ID NO: 374904 - DNA, 645 bp, Homo sapiens
  misc_feature: GZ8MTXP01ARKQ7.51.26.C04.1.454.CMB.2.raw
  modified_base (422)..(422): a, c, t, g, unknown or other
  modified_base (485)..(485): a, c, t, g, unknown or other
  modified_base (511)..(511): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggatataagtttggggtactaagttatgtttcgtggtatcaacatccacccaggcccggtaccccgatactcgctcctcgtatcatgactcgacccaaggccggcccctcgacggggactcccctaggacgtcgtacttcctcgtcggccctacccaaaaccgttcgtcgggggacaccgacgcccaacttcgcggaacccncgtcccgggaccgggaccccagggctgggtggagtcggaacggcgttacgaccttagtttacncggggtacgaggggcggtagggacgnggggagtcgtggtcggtaggtttcgggcgggtacggtccacggttcgccggaccgttaccgttggccgacgggaccccggaaggtcccgttcccgccccccggttagggttccctaacccgttccgttcccccg

SEQ ID NO: 374905 - DNA, 649 bp, Homo sapiens
  misc_feature: GZ8MTXP01CTGQJ.51.26.C04.1.454.CMB.2.raw
  modified_base (260)..(260): a, c, t, g, unknown or other
  modified_base (307)..(307): a, c, t, g, unknown or other
  modified_base (455)..(455): a, c, t, g, unknown or other
  modified_base (521)..(521): a, c, t, g, unknown or other
  modified_base (595)..(595): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtcgtccccaggacagacacgccacatccacctgctcgtggagtattaagtttggggtactaagttattgtttcgnggtatacaactatccaccgacggcccggtacccatacgtgcctcctntagtcagtgatcgaccacggccggccctaggacgggtactcccgtaggacgtcgtaccttccgtcgtcggtaccctacccgtaaaacgttcccgaaggggacccacgaacgcccaactcgacgaaccctcggcccggaccgggaccgnggtcgtggaggtagtagacgtactagtacttagtcggtgggtacggaggggtcgggtacgggaggngggcgtcggtagtcggttacggtcggggacggacggtcgtcggttccgtaccgttaccggttacgtacggaccnccgggacccgcggtcccgtcccgtccccgggttcttaccgtcccgttccgtccc

SEQ ID NO: 374906 - DNA, 647 bp, Homo sapiens
  misc_feature: GZ8MTXP01A69OH.51.26.C04.1.454.CMB.2.raw
  modified_base (286)..(286): a, c, t, g, unknown or other
  modified_base (593)..(593): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcacctttcgacaacttttaatatgcactgggtgcgccgggctccaggcaaggggctgggagtgggtggctgttataacttctgatggaggtacaacatattacncagacgccgtgaggggccgattcaccatctccagacgacaattacccgggaacacactgtctctgacaaatcgaaacagcctagagaagctggaggacgagggcttagtttattacgtgttgtgacgagtcccgactcgtacgtgggtacgggtacgttacttcctcgacgtaacggtagtcgggacgttcgtacggggaccaacgggaccgacggtacaccgttccttaccttacgcccttaaccgaacccgaaacggggccccttaacgttcccgggttcccttccccccgttcgggttaccccncccctttccccaacccgaaacgacgacccgtaaccccgtttcggtcccgggggg

SEQ ID NO: 374907 - DNA, 612 bp, Homo sapiens
  misc_feature: GZ8MTXP01BKI4N.51.26.C04.1.454.CMB.2.raw
  modified_base (223)..(223): a, c, t, g, unknown or other
  modified_base (297)..(297): a, c, t, g, unknown or other
  modified_base (414)..(414): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcactgctctgganataagtttggggtactaagtattgtttcgtggtatcaacatccacccaggcccggtccccgatactcgctcctntatcatgatcgaccaacgccggccctcgagggactccccgtgacgcgtacttctcgtggcctccaaacgtcgtggggacacgacgcccactctacgaccacgtccgacgggacccgnggcgtggtaggagtggacgtctacgtacttacgttacgtcggggtcggtaggggtcgggtaggggacggacgggcggcggtcggtcggttacggttcgggacgggacgggaacgtcggttcgtaccggttccgtaccgtacggccgccggacccgaacggtccgtcccggtccccgtcggttcctccgttccgtcccg

SEQ ID NO: 374908 - DNA, 616 bp, Homo sapiens
  misc_feature: GZ8MTXP01CUSYX.51.26.C04.1.454.CMB.2.raw
  modified_base (262)..(262): a, c, t, g, unknown or other
  modified_base (285)..(285): a, c, t, g, unknown or other
  modified_base (454)..(454): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaactttaatatgcacgtgggtgcgccgggctccgaggcgaaggggctggagtgggtgctgttataacttntgatggaggtacaacatattacncagacgccgtgacggggccgattcaccatcctaccagacgacaaacttccgggaacacactgtctctgacaatcgaaacagcctagagaagcgtgaggacgagggtctgtttattacgtggtagtgcgactccgacctcgacgttcgggtacgggtatttaccgttccnccggtacgtaaacgggttgttcggggaaccgttcggtacggggaccaacggggaccacggggtcaccgttctaccgttacgccctaaccgacgacggtcccacgttccggtcccttccccgttgccaaccccgtctaaccgagacgcctaacgttcgcgggg

SEQ ID NO: 374909 - DNA, 593 bp, Homo sapiens
  misc_feature: GZ8MTXP01BM4D5.51.26.C04.1.454.CMB.2.raw
  modified_base (203)..(203): a, c, t, g, unknown or other
  modified_base (263)..(263): a, c, t, g, unknown or other
  modified_base (284)..(284): a, c, t, g, unknown or other
  modified_base (573)..(573): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggagtccctcagactctcctgtgcagcctctggctttcaccttcgaactaacttttaanatgcacgtgggtgccgccgggctccgaggcaaggggctggagtgggtgctgttatacttngatggagtacaacatattacncagacgcgtggagggccattcacatctaccagagacaagttccgggaacacactgtctctgacaaatcgaacagctgagaagctggacggacagggtcttagtttatacgtgtgtgacgtatcccgactagtacggttggtaacggggtacttactcccgtcgaacgtaacggtggtcggtaacggtcgtacgggggaccaacgggaccacggtccaccgtcttcttacgccctaaccacgacgggcccagtccggtccttccccgttgaccctcccgtccaacgaacncgccaaccgttcgggccggg

SEQ ID NO: 374910 - DNA, 615 bp, Homo sapiens
  misc_feature: GZ8MTXP01CH851.51.26.C04.1.454.CMB.2.raw
  modified_base (261)..(261): a, c, t, g, unknown or other
  modified_base (527)..(527): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccacctcagtgtccgtgtccccaggacagacagccacatcacctgctctggagataagtttggggtactaagtatgtttcgtggtatcaacntcacccgaggccgtccccgatactgctcctctatcatgatgccaagccggccctgagggtactccctgacgcgtacttcgcttggccttccaaacgtcgtcggggacacgacgccactcgtacgacccacgtccggaccgggaccctagggccgtggtcggagttggacgggtctacgaacttattacgtcggggtacgtaagggtccgggtagggaccgagggggacgcgtcggcgttaggtttcggggcgggtagggtaaccgnggttccgtcggacccggttaccgtaggaccgccgacccggtaaggcccgtccgtcccccgttcgggttcctccggttccgtttccccg

SEQ ID NO: 374911 - DNA, 687 bp, Homo sapiens
  misc_feature: GZ8MTXP01BCEDN.51.26.C04.1.454.CMB.2.raw
  modified_base (284)..(284): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgactaactttaatatgcacgtgggtgcgccgggctccgaggcgaaggggctggagtgggtgctgttataacttctgatggagtacaacatatacncagacgcgtggacgggccgatcaccatctaccagacgaacaacgttccgggaaacacactgtctctagacaaatcgaacagcctgagaagcgtggagacgagggtcttagtttattacgtgtagtcgacgtactcccgacctcgtacggttcgggttaacggggtacgtttaccttcccgtaccggacgtaaacgggttgggtacgggtacggttccgtacgggggacccgaaacggggtacccgtaacgggtcccgtaacccggttcccgttacccgttaaccgccccgtaacccgaaacccggaaccggggtccccttacggttcccggttccccttcccccgttcggaccctaaccccgtcctaaccgaaacgtcgaccctaaccgttcgggaaccgggg

SEQ ID NO: 374912 - DNA, 544 bp, Homo sapiens
  misc_feature: GZ8MTXP01EDAP7.51.26.C04.1.454.CMB.2.raw
  modified_base (224)..(224): a, c, t, g, unknown or other
  modified_base (390)..(390): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctgganataattggggtctaagtatgtttcgtggtatcaacatcacccaggccgtccccgatactgctcctctatcatgatgcaagcgccctcagggatccctgagcgtacttctctggctccaaactctggggacacgagccactctcgaccactccgcgggacccaggcngtaggatgagctgactattactggtcgaggccgtgggacgagggaggctggcgtagtttcgggcgggagggccgagttcgtcgttaaccgtcgtacggttcgcgccccgaaggtccgtccgtcccccgtcggttcctaaccgttcctttccccg

SEQ ID NO: 374913 - DNA, 700 bp, Homo sapiens
  misc_feature: GZ8MTXP01DT2TC.51.26.C04.1.454.CMB.2.raw
  modified_base (177)..(177): a, c, t, g, unknown or other
  modified_base (223)..(223): a, c, t, g, unknown or other
  modified_base (250)..(250): a, c, t, g, unknown or other
  modified_base (255)..(255): a, c, t, g, unknown or other
  modified_base (258)..(258): a, c, t, g, unknown or other
  modified_base (277)..(278): a, c, t, g, unknown or other
  modified_base (284)..(284): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtcgtccgtgtccccaggacagacagccacatcactgctctgganataagttggggtactaagtatgttcgngtatnaantcaccagccggtccatacnnctcctnagtcatgatcgacaaggtccggccctagagggtactccgtagacgtctattcctcgtcggtaccctacccgaaaacttcgggtaacgggggaccaaacctacggacccctattccggtacgaaccctacgtcccgggaccgggacccgaagggtcgtggttaggtacgtaggaggaccgtaacgtaacgttaatttaaaccgttcggggttacggtaacggggtacgggtacggggaacgggtaacggggtaacggggtacggtacggttacggttacgggttaccggggtacggggtaacgggtaaccggtacggttacggtaccggttacccggttaccggtacggttaccgaccggacccggaaccggtaccggtcccgtccccgtcccggttaccgtaaccgttccgtcccg

SEQ ID NO: 374914 - DNA, 562 bp, Homo sapiens
  misc_feature: GZ8MTXP01CWNF1.51.26.C04.1.454.CMB.2.raw
  modified_base (419)..(419): a, c, t, g, unknown or other
  modified_base (450)..(450): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttgggggtctaagtatgtttcgtggtatcaacatcaccccaggccggtccccgatactgctcctctatcatgatgccaagcggccctcagggatccctgagcgacttctctggcctccaaactctggggacacagccactctcgacccatcccggcgggaccccagggctcggtggatggagcgtgactntacctgggtcagggccgtgggacgtaggggngacgtgcgtagtttcgggtcggagggccaggctggcccgttaccgcgggttcgcggccccgaagggtccctcggtaccccccgtcgggttaccctaaccgttccgttcccgg

SEQ ID NO: 374915 - DNA, 653 bp, Homo sapiens
  misc_feature: GZ8MTXP01DJ98H.51.26.C04.1.454.CMB.2.raw
  modified_base (264)..(264): a, c, t, g, unknown or other
  modified_base (288)..(288): a, c, t, g, unknown or other
  modified_base (294)..(294): a, c, t, g, unknown or other
  modified_base (505)..(505): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccacctcagtgtccgtgtccccaggacagacagccacatcactgctcgtggagtattaagtttggggtactaagtattgtttcgtggtatcaacntacacccaggcccgtcccgatacngctctntatcatgatcgaccacggccgccctcgacgggactcccgtggacgcgtacttcctcgtcggcccttaccgaaaaccgtcgtcggggaaccacgaccgccctaactctacgacccacgtcccggccgggacccgaggtcgtggtcggagtcgacgggtctacgtaacttacgttacgtacgggtcgtaaggggtccggtagggggaaccggnggggacggtcgttagggtcggttaacggtttcgggggcgggtaacggaaccgtggttccgacggttacccgttcggtaacgttccggaccgaccccggaaggcccgttcccggcccccgttacggccttaaccgttcccgtttccccg

SEQ ID NO: 374916 - DNA, 634 bp, Homo sapiens
  misc_feature: GZ8MTXP01CNCIP.51.26.C04.1.454.CMB.2.raw
  modified_base (259)..(259): a, c, t, g, unknown or other
  modified_base (281)..(281): a, c, t, g, unknown or other
  modified_base (397)..(397): a, c, t, g, unknown or other
  modified_base (580)..(580): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaactttaatatgcactgggtgcgccgggctccaggcaaggggctgggagtgggtgctgttatacttntgatggaggtacaacatatacncagacgccgtgaggggcgattcaccatcctaccagagacaacgttccgggaacacactgtctctgacaaatcgaacagcctagagaagctggaggacgagggtctaggttattacngtgtgcgactccgacctcgacgtcgggtaacggggtgtttaccttccgtccggacgtaacgggtacgtgggtaaccgttcgtacgggggacccgaaaggggacccgtacgggtccaaccggtcctccgttaacgcccttaacccgaacgaacggggtcccagtcccggttcctttacccccgngggttaccctaaccccgtccctaaccaaggtcgcctaacccgttcggtcggggg

SEQ ID NO: 374917 - DNA, 678 bp, Homo sapiens
  misc_feature: GZ8MTXP01CJI2E.51.26.C04.1.454.CMB.2.raw
  modified_base (178)..(178): a, c, t, g, unknown or other
  modified_base (220)..(220): a, c, t, g, unknown or other
  modified_base (252)..(252): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcacgccaccctnagtgtccgtcgtcccaggacagacacgccacatcactgctcnggatattaagttgggtactaagtattgttcgnggtatcactactcaccgacggcccgtacccgatactcgcctctctatcatgagtacgaccgtacggccggcccttacgacggggtacctcccgtgacgtcgtacttccgtctcggcctccgaaaaccgtcgggtcggggaccacgaccggtccctaaccttcgaccgaacccgtacgtcccgggaccgggacccgtagggccgttagggtacggtacgttagggacgggtacgtacggtaacttacgtttaaccggtcggggttacggacggggttcggtacggggaacgacgggggtcggtcggtacggtcggttacggtttacggggacgggtacgggaacccgtagttccggtcgttaccgtcggtcgttacgcggcccgaacgtctaacccggtcccgtcgttcctccgttccgttaacccg

SEQ ID NO: 374918 - DNA, 673 bp, Homo sapiens
  misc_feature: GZ8MTXP01AS7DW.51.26.C04.1.454.CMB.2.raw
  modified_base (258)..(258): a, c, t, g, unknown or other
  modified_base (277)..(277): a, c, t, g, unknown or other
  modified_base (287)..(287): a, c, t, g, unknown or other
  modified_base (349)..(349): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaactttaatatgcactgggtgcgccgggctcgaggcaaggggctggagtgggtgctgttatacttngatggagtacacatatacnagacgcgtgngggccatcacatctccagacgacaacgttccggaacacactgtctactagacaaatcgaacngcgtagagaagcgtggaacggagacgggtctttagtttacttacgttaggtgtcgacgtaccgtccgtacctagtacggttcggggtaacgggtactttacccttccgacgtacgtaacggtaggtcgggtacgtcgggtacgggacccgaacgggacccgtacggaccgttaccgtcccgtttaccgtaaccggtcccaacccggtaacccgttaaaccgggcccttaccggttcccgggttccccttcccccggttcgacccctaaccccgttaccccgaacgaaccgtccgacccgtaacccggttcggggtaacccgggg

SEQ ID NO: 374919 - DNA, 683 bp, Homo sapiens
  misc_feature: GZ8MTXP01CQ7LH.51.26.C04.1.454.CMB.2.raw
  modified_base (264)..(264): a, c, t, g, unknown or other
  modified_base (286)..(286): a, c, t, g, unknown or other
  modified_base (343)..(343): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgactaacttttaatatgcacgtgggtgccgccgggctcgaggcgaaggggctggagtgggtgctgttataacttngatggaggtacaacatattacncagacgcgtggagggccattcacatctccagagacaacgtccggaacacactgtctntcgacaaatcgaacagcctagagaagcgtggaggacgagggtctgtttatactgtgtgcgactccgacctcgacggttcgggtaccgggtatttaccgtccgtaccggacgtaacgggttaggtcggggtaaccggttcggtaccggggggaacccaaaccgggggtacccgtaccgggttccctacccggttcccttaccccgttacggccccttaacccgaaaccggacccggggtccccttacggtttccccggtcccctttacccccgttcggaccccctaaccccgtaccgtaacccgaaaggccgacccgtaaccggttccgggtaaccggggg

SEQ ID NO: 374920 - DNA, 652 bp, Homo sapiens
  misc_feature: GZ8MTXP01CSLBP.51.26.C04.1.454.CMB.2.raw
  modified_base (284)..(284): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgaactaactttaatatgcacgtgggtgcgccgggctccaggcgaaggggctggagtgggtgctgttataacttctgatggagtacaacatattacncagacgcgtgacgggcgatcacatctacagagacaagtccggaacactactgtctctagcaaatcgaacagctagagagctggagacgagggtctagtttacttacgtgtgtgacgtacgtccgacctacgacggttcggggtaacggggtacgtttacgttcccgtaccgtacgtaaaccgggttaggtcggggaaccgttcgggtacgggggacccgaaacggggacccgacggtaccgtaccgtccttcccgttaacgcccctaaccaacccgacgggtcccacgttcccggtcccttacccccgttggcccctaaccccgtccctaaccgaacgtaccgccctaacccgttcggtaaccggggg

SEQ ID NO: 374921 - DNA, 693 bp, Homo sapiens
  misc_feature: GZ8MTXP01CYAHQ.51.26.C04.1.454.CMB.2.raw
  modified_base (181)..(181): a, c, t, g, unknown or other
  modified_base (307)..(307): a, c, t, g, unknown or other
  modified_base (311)..(311): a, c, t, g, unknown or other
  modified_base (315)..(315): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggactccctggccgcctatcgacctgactcacgccacccctnagtgtccgtcgtccccaggacagaccagcccaacatccacctgctcgtaggaagtattaagtttggggtacttaaggttagttgttcgtggtatacaacatccacccgaggcccgtcccatactcnctcntatnagtgatcgacacgccgtacctcgagggtactccctagagtcgtacttcgacgtggaccctaccgtaaaccgtaggtcgggacaacgacggaccctactccgacaccgtaccgacccggaccggaccgaggtcgtagggtaggaagtcggaacgggtaccgtaggtaacttaacttaccggtaggggttaaccggggaggggttacgggtaccgggaaacggggaggggaacggttcgtaacgggtcggttaaacgggtttccggggacggggtaaccgggtaacgtcggttacggtccggacccggttacccggtgaaccggccgttaccggtaacgcccgtccggtcccccgtgttacccgtcgttcctttcccccg

SEQ ID NO: 374922 - DNA, 711 bp, Homo sapiens
  misc_feature: GZ8MTXP01B5I43.51.26.C04.1.454.CMB.2.raw
  modified_base (259)..(259): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccgaggcaaggggctggagtgggtgctgttataacttngatggaggtacaacatatactcagacgccgtggaggggccgattcaccatctccagagacaacttccgggaacacactgtctctgacaaagtcaacagcctagagagctggagggacgaggggtctttagtttaacttacgttggtagtgaccgtacgtccccgtaccgttcgaaccggttggggttaacgggggtacgtttaccgttcccgtccggtaccgtaaacggggttacgttacggggtacgggttccggtacgggggacccgtaaaccggggaccccgtaccggggtaccctacccgttcccgttacccgtttaccggccccttaaccccgaacccggaacggggtcccccttacgtttcccggtccccttccccccgttcgggttacccctaacccccgtccctaaccgaacggacgttccccaaccgttccggtaaccggggg

SEQ ID NO: 374923 - DNA, 627 bp, Homo sapiens
  misc_feature: GZ8MTXP01AQKCY.51.26.C04.1.454.CMB.2.raw
  modified_base (286)..(286): a, c, t, g, unknown or other
  modified_base (538)..(538): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcacgtgggtgcgccgggctccgaggcgaaggggctgggagtgggtggctgttataacttctgatggaggtacaacatattacncagacgccgtggagggcgattcaccatcctacagagactaacgttccgggaacacacgtgtctctgacaaatcgaacagcctgagaacgcgtggaggacgagggtcttagtttactacgtgtgtgacgtacgtcccgacctcgtacggttcgggtacggggtactttacccgttccgtaccgtacgtaacggtcggtgggacgtcggtcggggaccgaacggggcccacggtccaccgttcctaccgttacncccgtaaccaccgacggtcccacgttccgtcccttccccgcggccctaaccctccctaacgaacgcgacctaaccgttcggaaccgggg

SEQ ID NO: 374924 - DNA, 605 bp, Homo sapiens
  misc_feature: GZ8MTXP01E15XW.51.26.C04.1.454.CMB.2.raw
  modified_base (211)..(211): a, c, t, g, unknown or other
  modified_base (258)..(258): a, c, t, g, unknown or other
  modified_base (279)..(279): a, c, t, g, unknown or other
  modified_base (351)..(351): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactggtncgccgggctcaggcaaggggctggagtgggtggctgttataacttcngatggaggtacaacatatacncagacgcgtgagggccgattcaccatctccgagagacaattccgggaacacactgtctctgcaaatcgaacngcctgagaagctgaggacagggtctgttaattactgtgtgcgtactccgacctcacgtgggtacgggtacgttaccttccctccgacaacggtagtcgggacgtcggtacgggtccgaacgggacccgaccggtccacccgtcctccgtaacgccctaaccaaccgacgggcccacgtcccggtcccttcccccgttcgacccgtaacccctcccgtaacccgaacgaccgacctaacccgttcggtccggggg

SEQ ID NO: 374925 - DNA, 694 bp, Homo sapiens
  misc_feature: GZ8MTXP01AIPEY.51.26.C04.1.454.CMB.2.raw
  modified_base (156)..(156): a, c, t, g, unknown or other
  modified_base (270)..(270): a, c, t, g, unknown or other
  modified_base (283)..(283): a, c, t, g, unknown or other
  modified_base (290)..(290): a, c, t, g, unknown or other
  modified_base (377)..(377): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctnagactctcctgtgcagcctctggcttcacctttcgaactaactttaatatgcacgtgggtgccgccgggctccgaggcgaaggggctgggagtggggtgcttagttataacttngatggagtacaanatatacncgagcgcgtgacgggccattcaccgatctaccaagacactaacgttacccgggaacacctactcgtcctctagacaaatccgaaacngtcctagagacgcgtggaacgacgagggtctttagtttaacttacgtgtcgtcgacggtactcccggactacgtacgggtacggggttaacggggtactttaccgttcccgtaccggtacgtaaacggttgggtacgggtacggttcgggaccggggaaccgaacgggacccgtacgggtaccctaccggttccctaccgtaccgcccgtccccgaaacggttaccgggtacccttacgttcccggtacccttcccccgcggacccctaacccccgtaccaaccgtaacgccgccctaaccgttcgggtaaccgggg

SEQ ID NO: 374926 - DNA, 755 bp, Homo sapiens
  misc_feature: GZ8MTXP01CG36J.51.26.C04.1.454.CMB.2.raw
  modified_base (261)..(261): a, c, t, g, unknown or other
  modified_base (282)..(282): a, c, t, g, unknown or other
  modified_base (357)..(357): a, c, t, g, unknown or other
  modified_base (409)..(409): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctgttggagtctggggggaggcgtggtccagcctgggaggtccctcagactctcctgtgcagcctctggcttcaccttcgactaactttaatatgcacgtgggtcgcgccggctccgaggcgaaggggctggagtgggtgctgtatacttntgatggagtacaacatatacncagacgccgtgagggccattcacatctccagacgactaagttccgggaacacactgtctctagacaaatcgaacngcctgagaacgcgtggacggtacgagggtcttagtttacttacgtggttcgngtaccgtactacccggtaccttcgtaacggttcggggtaaccgggggttactttacccgttcccgtaccgtacgtaaacgggttacggtacgggtaaccggttccggtacgggggacccgtaaacggggtaccccgtaaaccgggttcccgtaaaccccggttcccttacccgtttaaccggcccccgtttaaccccggaaaccccggttaacccggggtacccccttaacgggtttacccccgggtttcccctttaacccccccggttcgggttacccctaacccccgttacccgttcccgaaaacggtccgttaccccgtaacccgttccggggtccccggggg

SEQ ID NO: 374927 - DNA, 679 bp, Homo sapiens
  misc_feature: GZ8MTXP01EVWGQ.51.26.C04.1.454.CMB.2.raw
  modified_base (266)..(266): a, c, t, g, unknown or other
  modified_base (287)..(287): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgactaacttttaatatgcacgtgggtgccgccgggctccgaggcgaagggggctgggagtgggtgctgttatacttngatggagtacaacatattacnagacgccgtgacgggcatcacatctcagagacaagttccggaacacactgtctctgacaaatacgaactagccgtagagaagcgtggaggacgtagggtctttagttttagtacgttggtagtcgacgtactcccgtacctcgtaacggtcggggttaacggggtactttaccgttcccgtaccgtacgtaacgggtaggtcgggtaccggttcgggtacggggaccgaacgggtacccgtaccggtacctaccggttccttacccgtacgtccccgtaacccgaaacccggaacgggtccccttaacgttccccggttcccttcccccgttggacccctaaccccttcccgaaccgaacgtcgaccctaaccggttcgggtaacccggggg

SEQ ID NO: 374928 - DNA, 645 bp, Homo sapiens
  misc_feature: GZ8MTXP01B6N9K.51.26.C04.1.454.CMB.2.raw
  modified_base (504)..(504): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatccacctgctcgtggatattaagtttggggtcttaagtatgtttcgtggtatcaacatcacccaggcccggtccccgatactcgcctcctctatcatgatgaccaacgccggccctcgaggactcccgtgagcgtacttctcgtcggcctacccgtaaacgtccgtcggggacaccgacgccctactctacgacccacgtcccggaccgggaccccagggccttagggtagggtacgtggtacgggtcttagtaccttagttaccgtggggttacgaggggtcgggcgggaacgnggggtaggtcgtagcggttaggtttcgggacgggtcgggaaccgtagttcgtccggaccggttccgtaacggttccgaccgggacccgtaacgggccgtccccggtcccccgttacgggttcctccgttcccgtttcccgg

SEQ ID NO: 374929 - DNA, 703 bp, Homo sapiens
  misc_feature: GZ8MTXP01ENERN.51.26.C04.1.454.CMB.2.raw
  modified_base (153)..(153): a, c, t, g, unknown or other
  modified_base (201)..(201): a, c, t, g, unknown or other
  modified_base (261)..(261): a, c, t, g, unknown or other
  modified_base (274)..(274): a, c, t, g, unknown or other
  modified_base (279)..(279): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggagcgtggtccagcctgggagtccctnagactctcctgtgcagcctctggcttcaccttcgaactaacttttaanatgcacgtgggtgcgccgggctccgaggcaaggggctggagtgggtgctgttataacttngatggagtacaantatcncagacgcgtgagggccatcacatcctaccagtacgaactaacgttcccgggaaacaccgtaacttcgtacttctagacctaaagtccgaaactagaccgtagacgaacgcgtaagggacggaaccgtagggttcctttagttttactacgtgtcgtcgacgtactaccggtacctacgtaacggttcgggggttaacgggtactttaacccgttcccgtacggtaacgtaaccgggttaggtcgggtaaccggtttcggacggggaacccgaaacgggggaccctaaccgggtcctaccggttccttaccgttacgcccgtaacccgaacggaaaccgggtccccttacggttcccggtcccttccccgttgaccctaaccccttcgaaccgaaacgcgaccctaaccgttcgggaacccgggg

SEQ ID NO: 374930 - DNA, 636 bp, Homo sapiens
  misc_feature: GZ8MTXP01CWA34.51.26.C04.1.454.CMB.2.raw
  modified_base (179)..(179): a, c, t, g, unknown or other
  modified_base (246)..(246): a, c, t, g, unknown or other
  modified_base (404)..(404): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtcccttgcttactgcacaggatccctggcccgcctatgacctgactcagccaccctnagtgtccgtgtccccaggacagacagccacatccactgctctggagtatagtttggggtctaagttntgtttcgtggtatcaacatcaccccgaggcccggtccccgatactcgcctcctctatcatcgatcgaccgaagcccggccctacgacgggacttccccgtgacgcgtacttcgtcgtgcctccaaaccgtcgtggggacacgcgccactctacgaccncgtcccgggaccgggacccgagggtccgtagggtagggtacgtaggacgggtcttaggtaaccttacgtttaaccggtgggtaccggtaagggggtccggtacgggggtaaccgagggggtacggtcgttaccggtcggttaaggtttccggggacgggtcggaacgtgcgtccgacgtcgtagccgcgaccgaacggccgtccgtcccgtcgttacctccgttcgttcccc

SEQ ID NO: 374931 - DNA, 743 bp, Homo sapiens
  misc_feature: GZ8MTXP01DFLHU.51.26.C04.1.454.CMB.2.raw
  modified_base (201)..(201): a, c, t, g, unknown or other
  modified_base (280)..(280): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaactttaanatgcacgtgggtgcgccgggctcaggcaaggggctggagtgggtgctgttataactctgatggagtacaacatattacncagcgcgtgaggggcattcaccatcctccagacgaactaagttaccgggaacactactgtactctgacaaatcgaacacgctgagaagctggaaggacgaggggtcttagtttactacgtggtgtcgcgtacgtcccgaaccttcgaaacggttcggggtaacggggttaccgtttaaccttcccgtaccggtaacgtaaacccggggttaggttacgggggtaaccggttacgggttaccggggggaaccctaaaaccgggggtaccccgtaccggggttaaccccgtacccgtttccgtttaccccgttacggtacccccgttaacccgaaacccgggttaaaccggggtacccccttaaggtttccccgggttcccctttaccccccggttggttaccccctaacccccgtaccttcccgaaaacggccgaccgtaaccccggttcgggtaacccggggg

SEQ ID NO: 374932 - DNA, 751 bp, Homo sapiens
  misc_feature: GZ8MTXP01A06AM.51.26.C04.1.454.CMB.2.raw
  modified_base (176)..(176): a, c, t, g, unknown or other
  modified_base (218)..(218): a, c, t, g, unknown or other
  modified_base (224)..(224): a, c, t, g, unknown or other
  modified_base (242)..(242): a, c, t, g, unknown or other
  modified_base (258)..(258): a, c, t, g, unknown or other
  modified_base (289)..(289): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccacctnagtcgtccgtgtccccaggacagacagccacatccactgctntagganattagttgggactaagtnttgttcgtgtatcacntcaccgacggccgtcccgatactcgctcctntatcatgactgccaaggccggtccctcgagggtctcccgtagacgtaccgtattcctcgtcgggccttacccgtaaaaccgtcgggtaacgggggaaccaccgtacggtacccccacgttacgtaccgaaacccaccggtcccgggtacccggggaacccgcgggtccgttaggggtacggtacggttagaacggggtcccttaagggaacctttacgttaaaccgttcgggggttcccggaagggggttccgggtaacgggggaaccggagggggtacgggtccgtacggggtacggtttaacgggtttccgggggaaccgggtcgggtaaacccggtggttacccggtacggttacccggtttaccgaacggggttccgacccggggacccgtaacggggtcccgttaaccccggccccccggttacggggttaccctccggtttccccgtttcccccgg

SEQ ID NO: 374933 - DNA, 716 bp, Homo sapiens
  misc_feature: GZ8MTXP01BM45A.51.26.C04.1.454.CMB.2.raw
  modified_base (260)..(260): a, c, t, g, unknown or other
  modified_base (283)..(283): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgactaactttaatatgcactgggtgcgccgggctccaggcaaggggctggagtgggtggctgttatacttntgatggaggtacaacatattacncagacgccgtgaggggccatcaccatctccagagacaattccgggaacacactgtctctgcaaatcgaacagacctgagaaagctggaggacgagggcttagtttagttacttggtgtaggtcgtacgtacccgtacctaccgtacgttacggggttacggggtacgtttaccgttaccccgttccggaccgtaaaccgggttgtacggggtaaccggtcggttaccggggggtaccgaaaccgggggtaaccccgtaccggggtcccgtaaacccggttcccgtttcccttaaacgggtcccctaaccccgtacccgaaaccggggtccccaaccgttacccggttccccgtttcccccccgttcgggccccctaaccccgttcccttccccaaaccgggacgttcccgtaacccgttcggtaacccggggg

SEQ ID NO: 374934 - DNA, 691 bp, Homo sapiens
  misc_feature: GZ8MTXP01ERBYL.51.26.C04.1.454.CMB.2.raw
  modified_base (202)..(202): a, c, t, g, unknown or other
  modified_base (264)..(264): a, c, t, g, unknown or other
  modified_base (287)..(287): a, c, t, g, unknown or other
  modified_base (651)..(651): a, c, t, g, unknown or other
  modified_base (673)..(673): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggagcgtggtccagcctgggaggtccctcagactctcctgtgcagcctctggcttcaccttcgaactaacttttaanatgcacgtgggtcgcgccgggctccgaggcgaaggggctggagtgggtgctgttaatacttnggatggaggtacaagatattacncagacgccgtaggaggggcctagttcaccatcctaccagtacgaactaagtttcccgggaaactaccgaacgttcggtacttactacgacctaaaacgtcgaaaccaggtccctaggaacggaaacgtccgttgggacggtaacgaggggttctttagggttttaatacgttggttgttacgacggtactacccggtacttcggtaacgttggggtaacggggtactttacctcccgtacggtacgtaacggtagggtcggaacggttcggacggggacccaacgggccctacgggttccaccggtcctaccttacggccctaaccgaacgttaacgggcccttacgtccggtacccttcccgngcctaaccctctaacaacggcnctaaccgttggtccgggg

SEQ ID NO: 374935 - DNA, 529 bp, Homo sapiens
  misc_feature: GZ8MTXP02HIEW4.51.26.C04.1.454.CMB.2.raw
  modified_base (385)..(385): a, c, t, g, unknown or other
  modified_base (389)..(389): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatatactcagacgccgtgagggccatcaccatctccagagacaattccgggaacacactgtctctgcaaaatcgaaacagcctgagagctgaggacagggctgttatactgngtgngatccgacctcactggtacgggagttactcctccgcaacggtatggacgtcgtggggaccaagggaccacggtcacgtctcctagcctcacaggccatcgtctcccctgccaaccctcctccacgacgcacctcgcgggg

SEQ ID NO: 374936 - DNA, 547 bp, Homo sapiens
  misc_feature: GZ8MTXP02GIRT8.51.26.C04.1.454.CMB.2.raw
  modified_base (427)..(427): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaaacacactgtctctgcaaaatgaaacagcctgagagctgaggacagggctgtttattactgtgtgcgatccgactcactggtacgggagttacttccncgacaacggtatggacgtcgtggggccaaagggaccacggtcaccgtctccttagcctcaccaaggcccatcggtccttcccccgtgccaaccctccctcaaacgcgccacctcgcgggg

SEQ ID NO: 374937 - DNA, 509 bp, Homo sapiens
  misc_feature: GZ8MTXP02HQG54.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgtttcgtggtatcaacatcacccaggccggtccccgatactgctcctctatcatgatgccaagcggccctcagggatccctgagcgacttctctcggctccaactctgggggacacagccactctgacccatccgcgggacccaggctgtgatgagctgactattactgtctaggcgtgggacagggaggcgtgcgtagtttcgggcggagggacaggtctcgaccgtcacggtcagcccaaggctcgcccctggctactcttccg

SEQ ID NO: 374938 - DNA, 385 bp, Homo sapiens
  misc_feature: GZ8MTXP02GU239.51.26.C04.1.454.CMB.2.raw
  modified_base (384)..(385): a, c, t, g, unknown or other
tcagcgatcgtatacacgaccggtgctcgatttagtctagcgactttgggtttgggaatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtggggacaggggaggctgcgattttcggcggagggaccagtctgaccgtctaggtcagcccaaggctgccccctcggtcactctgttcccgccctcctctcgtagccactctgagcgggctggcaaggcgcatagnn

SEQ ID NO: 374939 - DNA, 518 bp, Homo sapiens
  misc_feature: GZ8MTXP02HJW3V.51.26.C04.1.454.CMB.2.raw
  modified_base (408)..(408): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagataattggggtctaagtatgtttcgtggtatcaacatcacccaggccggtccccgatactgctcctctatcatgatgccaagcggccctcagggatccctgagcgattctctggctccaactctggggacacagccactctgacccatccgcggacccaggctgtggatgaggctgactattacngtcgtaggcgtgggacaggggagcgtgcgtagtttcgggcggtagggaccgaggtctcggaccgtcgtacggtcacgcccgaaggctcgccccctcggtccactctcccg

SEQ ID NO: 374940 - DNA, 500 bp, Homo sapiens
  misc_feature: GZ8MTXP02IFQPQ.51.26.C04.1.454.CMB.2.raw
  modified_base (258)..(258): a, c, t, g, unknown or other
  modified_base (385)..(385): a, c, t, g, unknown or other
  modified_base (422)..(422): a, c, t, g, unknown or other
  modified_base (469)..(469): a, c, t, g, unknown or other
tcagcgatcgtatacacgaccggtgctcgatttagtctagcgactttgggtttgggctgggcctcaggaagcagcatcggaggtgcctcagccatggcatggatccctctcttcctcggcgtccttgcttactgcacaggatccctggccgcctatgacctgactcagccaccctcagtgtcccgtgtccccaggacagacagccaccatcacctgctctggagataatttggggtctaagtatgttcgtggtatcanatcaccagccggtccccgatactgctcctctatcatgatgcaagcggccctcagggatccctgagcgattctctggctccaactctgggggacacacgccactctgacccatccgcggacccaggcngtggatgaggctgactattactgtcaggcgtgggacngggaggctgcgatttcggcggtaggaccagtctgaccgtctaggtcngcccaaggctcgcccctcggtcactcgtccg

SEQ ID NO: 374941 - DNA, 533 bp, Homo sapiens
  misc_feature: GZ8MTXP02H9VGM.51.26.C04.1.454.CMB.2.raw
  modified_base (391)..(391): a, c, t, g, unknown or other
  modified_base (520)..(520): a, c, t, g, unknown or other
  modified_base (528)..(528): a, c, t, g, unknown or other
tcagcgatcgtatacacgaccggtgctcgatttagtctagcgactttgggtttgggctgagctgggtttcctcgttgctcttttaagaggtgtccagtgtcaggtgcacctggtggagtctgggggaggcgtggtccagcctgggaggtccctcagactctcctgtgcagcctctggctttcacctttcgacaacttttaatatgcactgggtgcgccgggctccaggcaaggggctggagtgggtggctgttataacttctgatggaggtacaacatatactcagacgccgtgaggggccgattcacatctccagagacaattccgggaacacactgtctctgcaaatgaacagcctgagagctgagacagggctgtttatactgtgtgngatccgactcactggtacggggagttacttcctcgcaacggtatgggacgtcgtggggccaagggaccacggtcaccgtctcctagcctccacacggccatcggtcctcccctggcaaccctctcaacncgcactcncgggg

SEQ ID NO: 374942 - DNA, 525 bp, Homo sapiens
  misc_feature: GZ8MTXP02FZNHT.51.26.C04.1.454.CMB.2.raw
  modified_base (259)..(259): a, c, t, g, unknown or other
  modified_base (398)..(398): a, c, t, g, unknown or other
  modified_base (489)..(489): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgtttcgtggtatcaanatcacccaggccggtccccgatactgctcctctatcatgatgccaagcggccctcagggactccctgagcgattctctggctccaactctgggggacacagcccactctgacccagtccgccgggacccaggctgtggntggagctgactattactgtcaggcgtggggacagggaggctggcgtagtttcgggacgggagggaccaggtctcggaccgtcgtacggtcncgcccgaaggcctcgccccctcggcacgtcttcccg

SEQ ID NO: 374943 - DNA, 551 bp, Homo sapiens
  misc_feature: GZ8MTXP02JD8UW.51.26.C04.1.454.CMB.2.raw
  modified_base (224)..(224): a, c, t, g, unknown or other
  modified_base (394)..(394): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctgganataagttggggtctaagtatgttcgtggtatcaacatcacccaggccggtccccgatactgctcctctatcatgatgccaagcggccctcagggactccctgagcgattctctggctccaactctggggacacacgccactctcgaccacgtccgccggacccaggctgnggatggagctgactattactgtcgaggcggtgggacgaggggaggcgtggcgtagttttcgggcgggacgggaccgaggtctacggaccggttccgtacggtaccgacggacccgaacggcctccggcccccgtcggtccaccgttcgtttccccgg

SEQ ID NO: 374944 - DNA, 629 bp, Homo sapiens
  misc_feature: GZ8MTXP02H8TUG.51.26.C04.1.454.CMB.2.raw
tcagcgatcgtatacacgaccggtgctcgatttagtctagcgactttgggtttgggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctgagataattggggtctaagtatgtttcgtggtatcaacatcacccaggcccggtccccgatactgcctcctctatcatgatgcaagcggccctcagggactccctgacgcgtactctctcggctccaactcgtcgggggacacgacgaccactctcgaccacgtccgccggacccacggcctagtcggagtggacggtcgtagacttagtttacgtcgttcgaacgggtcggtacgggggacggaacgggggcgggtccgtggtaccggttggttttcggggacggggtacggggaccgtacggttccgtcgggtaacccgtccgttacgggtaccgtaacggaccccgaacgggtcccgttacccggcccccggttccggtacccgtaccgttcccgtttccccggg

SEQ ID NO: 374945 - DNA, 561 bp, Homo sapiens
  misc_feature: GZ8MTXP02JHUSU.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtggctgttataacttctgatggaggtacaacatatactcagacgccgtgaggggccgattcaccatctccagagacaattccgggaacacactgtctctgcaaatgaacagcctgagagctgaggacagggctgtttatactgtgtgcgatccgacctcactggtacggggagttacgttcctccgcaaccggtatgggtacgtcgtggggccaagggaccacggtcaccgtctcctacgcctccaccaagggcccagtccggtccttcccccgtggccaacccgtccctaccgacgtacgccacctcgtacggggg

SEQ ID NO: 374946 - DNA, 618 bp, Homo sapiens
  misc_feature: GZ8MTXP02HIQI4.51.26.C04.1.454.CMB.2.raw
  modified_base (264)..(264): a, c, t, g, unknown or other
  modified_base (371)..(371): a, c, t, g, unknown or other
  modified_base (603)..(603): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcacgtgggtgcggccgggctccgaggcgaaggggctggaggtgggtggcttgttatacttntgagtggagtacaacatattactcagacgccgtggacggggcctattcaccatcctaccagacgaactaagttccgggaacacacgtgtctctgacaaatcgaaacngctagagagcgtggacggacgagggtcttagtttactgtgtgtcgacgtactccgacctcgtacggttaggggtacgggtactttaccgtcccgcgtacgtacggtgtcggtacgtcgggacggggaccgaacgggccgtacggtccgtaccgtccttaccgtacgccctaccgaccggaccggccctacgttcccgtccctcccgtcgccctaacccgtccgacgacgacnccgtacgtcggcggg

SEQ ID NO: 374947 - DNA, 579 bp, Homo sapiens
  misc_feature: GZ8MTXP02JLZ1S.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcactgctctggagataagttggggtctaagtattgttcgtggtatcaacatcaccaggccggtccccgatactgctcctctatcatgatgccaagcggccctcagggactccctgagcgattctctggctccaactctgggggacacagccactctcgacccatcccgcggacccaggcctgtcgatgaggctgacttattacctgtcgaggcgtagggaccgaggggaggcgtcggcggtaaggttttcgggacggggagggacccgtaggtccgtacgggtaacccgttccggtacgggttaccacggaccccgaaacgggccgttccgccccccgtacggggtccctacccggttcctttcccccgg

SEQ ID NO: 374948 - DNA, 552 bp, Homo sapiens
  misc_feature: GZ8MTXP02H6YBN.51.26.C04.1.454.CMB.2.raw
  modified_base (259)..(259): a, c, t, g, unknown or other
  modified_base (390)..(390): a, c, t, g, unknown or other
  modified_base (400)..(400): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttngatggaggtacaacatatactcagacgccgtgaggggccattcaccatctccagagacaattccgggaacacactgtctctgcaaatgaacagcctgagagctgaggacaggggctgtttatactgtgtgnaatccgactnactggtacgggattacttcctcgcaacggtatggtacgtcgtggggccaaggggaccacggtcacgtctccttacgccctcaccgacgggcccagtccggtccttcccccgtggcccaacccgtcctaccaacgcgccaccgtcgtcggggg

SEQ ID NO: 374949 - DNA, 513 bp, Homo sapiens
  misc_feature: GZ8MTXP02IUQ4S.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtcccgtgtccccaggacagacagccaccatcacctgctctggagataattggggtctaagtatgtttcgtggtatcaacatcacccaggccggtccccgatactgctcctctatcatgatgccaagcggccctcagggactccctgagcgattctctggctccaactctgggggacacagccactctgaccatccgcggacccaggctgtgatgaggctgactattactgtcaggcgtgggacagggagcgtgcgagtttcggcggagggaccagtctcgaccgtcgtacggtcacgcccaaggcctcgccccgtcggtccacgtcttcccg

SEQ ID NO: 374950 - DNA, 539 bp, Homo sapiens
  misc_feature: GZ8MTXP02HW4AK.51.26.C04.1.454.CMB.2.raw
  modified_base (385)..(385): a, c, t, g, unknown or other
  modified_base (422)..(422): a, c, t, g, unknown or other
  modified_base (443)..(443): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagataatttggggtctaagtatgtttcgtggtatcaacatcacccaggccggtccccgatactgctcctctatcatgatgccaagcggccctcagggatccctgagcgattctctggctcaactctggggacacagccactctgaccatccgcggacccaggcngtgatgaggctgactattactgtctaggcgtggacgnggaggctgcgtagtttcgggnggtaggaccgagttcgtacgacccgttaccgtacgggtcacggaccccgaaagggtcctcggtccccccgtcgggttcccaccgtttccttccccg

SEQ ID NO: 374951 - DNA, 519 bp, Homo sapiens
  misc_feature: GZ8MTXP02GG27H.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgtttcgtggtatcaacatcacccaggccggtccccgatactgctcctctatcatgatgccaagcggccctcaggggatccctgagcgattctctggctccaactctgggggacacagccactctgaccatccgcggacccaggctgtggatgaggctgactattactgtcaggcgtgggacagggaggcgtgcgagtttcgggcggagggaccagtcgtcggacccgtcgtacggtcacgcccaaggcctcgcccccgtcggtcaccgtcttcccg

SEQ ID NO: 374952 - DNA, 524 bp, Homo sapiens
  misc_feature: GZ8MTXP02G1ESV.51.26.C04.1.454.CMB.2.raw
  modified_base (503)..(503): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgttcgtggtatcaacatcacccaggccggtccccgatactgctcctctatcatgatgccaagcggccctcagggactccctgagcgattctctggctccaactctcgggggacacagccactctgacccatccgcggacccaggctgtcgatgaggctgactatactgtcagcgtgggacagggaggcgtgcgagtttggcggagggacaggtctcggaccgtcgtaacggtcgacgtcccgaaggtcctcggtcccccnccgggtccacgttccttcccg

SEQ ID NO: 374953 - DNA, 514 bp, Homo sapiens
  misc_feature: GZ8MTXP02HOFXA.51.26.C04.1.454.CMB.2.raw
  modified_base (224)..(224): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctgganataattggggtctaagtatgtttcgtggtatcaacatcacccaggccggtccccgatactgctcctctatcatgatgccaagcggccctcagggatccctgagcgattctctggctcaactctggggacacagccactctgaccatccgcggaccaggctgtgatgagctgactattactgtcaggcgtggggacagggagctggcgtagtttcgggcggtagggaccaggtctcggaccgtcgtacggtcacgcccgaaggctcgcccccgtcggtccacgtcttcccg

SEQ ID NO: 374954 - DNA, 545 bp, Homo sapiens
  misc_feature: GZ8MTXP02IIGYF.51.26.C04.1.454.CMB.2.raw
  modified_base (385)..(385): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcaccaggccggtccccgatactgctcctctatcatgatgcaagcggccctcagggatccctgagcgattctctgctccaactctgggggacacagccactctgaccactcgcggacccaggcngtcgagtgagcgtgactattactgttcgaggcggtgggacgaggggaggcgtggcgtagttttcggcgggacgggaccgaggtccgtcggtaccgtaccgtcggtaccgacgacccgaaacgggccgtccggcccccgtccggtccaccgtctttccccg

SEQ ID NO: 374955 - DNA, 598 bp, Homo sapiens
  misc_feature: GZ8MTXP02GFA33.51.26.C04.1.454.CMB.2.raw
  modified_base (223)..(223): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctgganataattggggtctaagtatgtttcgtggtatcaacatcacccaggcccgtccccgatactgcctcctctatcatgatcgaccaagccggccctcgaggggactcccgtgacgcgtacttcctcgtcggcctaccaaccgttcgtcgggggacacacgcccactctcgacccacgtcccggccgggacccgaggctcgtggacgtggaggctagacttattacgtggtcgagggcggtaggggacgaggggaggcgtggcgtagtttcggggcgggtacgggaccgtaggtctcggtaaccggtccgtacgggtaccgacggacccgtaacggcccgtccgtcccccgtcggtacccgtccgttccgtttacccgg

SEQ ID NO: 374956 - DNA, 383 bp, Homo sapiens
  misc_feature: GZ8MTXP02JGF9D.51.26.C04.1.454.CMB.2.raw
  modified_base (382)..(383): a, c, t, g, unknown or other
tcagcgatcgtatacacgaccggtgctcgatttagtctagcgactttgggtttgggaatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtggggacaggggaggctgcgattttcggcggagggaccagtctgaccgtctaggtcagccaaggctgccccctggtcactctgtcccgccctcctctcgtagcccactctgagcgggctggcaaggcgcatagnn

SEQ ID NO: 374957 - DNA, 559 bp, Homo sapiens
  misc_feature: GZ8MTXP02FZVUI.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttataacttctgatggaggtacaacatattactcagacgccgtgaggggccgattcaccatctccagagacaattccgggaacacactgtctctgacaaatgaacagcctgagagctgaggacagggctgtttattactgtgtgcgatccgactcacgtgggtacggggagtttacttcctccgcgaacggtatgggacgtcgtgggggaccaagggaccacggtccaccggtctcctagcctccaccaaggcccatcggtccttcccccgtggccaaccccgtctacccaacgacgcacctcgtcggggg

SEQ ID NO: 374958 - DNA, 528 bp, Homo sapiens
  misc_feature: GZ8MTXP02HM583.51.26.C04.1.454.CMB.2.raw
  modified_base (428)..(428): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggcccggtccccgatactgctcctctatcatgatgccaagccggccctcagggactccctgagcgacttctctggcctccaactctggggacacagccactctgaccatccgcggacccaggctgtgatgagctgactattactgtcaggcgtgggacgngggagcgtggcgtagtttcgggcggtacgggaccaggtctcgaccggtcctacgggtcacggcccgaaggcctcggcccccgtggtccaccgttctcccg

SEQ ID NO: 374959 - DNA, 520 bp, Homo sapiens
  misc_feature: GZ8MTXP02IO5K9.51.26.C04.1.454.CMB.2.raw
  modified_base (393)..(393): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggactccctgagcgattctctggctccaactctgggggacacagccactctgaccatccgcggacccaggctgtgntgagctgactattactgtcaggcgtgggacagggagcgtgcgtagtttcgggcggagggaccaggtctcggaccgtcgtacggtaccgacgacccgaaggctcgccccgtcggtccactccttcccg

SEQ ID NO: 374960 - DNA, 559 bp, Homo sapiens
  misc_feature: GZ8MTXP02HRPGB.51.26.C04.1.454.CMB.2.raw
  modified_base (331)..(331): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttataacttctgatggaggtacaacatatactcagacgccgtgaggggccgattcaccatctccagagacaattccgggaacncactgtctctgcaaatcgaacagcctgagagctgaggacagggcttgttattactgtgtgcgatccgactcacgtggtacggggattactccgtccgacaacggtatcgggtacgtcgtcgggggaccaaggggccacggtcaccgtctcctagcctccaccacgggcccagtccggtccttcccctggcctaacccgtcctaccaacgacgcctacctcgtcggggg

SEQ ID NO: 374961 - DNA, 611 bp, Homo sapiens
  misc_feature: GZ8MTXP02JSRWF.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttatacttctgatggaggtacaacatatactcagacgccgtgaggggccgattcaccatctccagagacaagttccgggaacacactgtctctgacaatcgaacagcctgagagctggaggacgagggcttgtttattacgtgtgtgcgatccgactcacgtgggtacggggtacgttacttccctccgacgtaacgggtagtcgggtacgttcgtcgggggaccgaacggggcccacgggtccaccggttctccgttacgccctaccgaccgaacgggccccagttcccgggtcccttccccccgtcggtccccaacccctcccgtaccgaacggaccgcctaacccgtcggtaccggggg

SEQ ID NO: 374962 - DNA, 584 bp, Homo sapiens
  misc_feature: GZ8MTXP02F6NNO.51.26.C04.1.454.CMB.2.raw
  modified_base (260)..(260): a, c, t, g, unknown or other
  modified_base (283)..(283): a, c, t, g, unknown or other
  modified_base (356)..(356): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtggctgttataacttntgatggaggtacaacatattacncagacgccgtgagggccgattcaccatctccagagacaattccgggaacacactgtctctgacaaatgaaacngcctgagagctgagacagggctgtttatactgtgtgcgtatccgacctcgactggtacggggtagttacttacctccgacaacggtatacggacgtcgtggggccaaacgggaccaacggtcaccgtctaccttacgcctaccaccgaaacgggcccactccggtccttcccccgtcggaccctaaccccgtcctacccgaaacgacgaccaacccgtcgtccggggg

SEQ ID NO: 374963 - DNA, 557 bp, Homo sapiens
  misc_feature: GZ8MTXP02G29VK.51.26.C04.1.454.CMB.2.raw
  modified_base (436)..(436): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggagtacaacatattactcagacgccgtgaggggccgattcaccatctccagagacaattccgggaacacactgtctctgacaaatcgaacagcctgagagctgagacagggctgtttatactgtgtgcgatccgactcacgtggtacggggattactcctccgacaacggtntgggtacgtcgtggggaccaagggccacggtcaccgtctcctagccctccaccgacgggcccagtccggtcctcccccgtggcccaaccccgtcctaccaacgcgccaccgtcgtccgggg

SEQ ID NO: 374964 - DNA, 693 bp, Homo sapiens
  misc_feature: GZ8MTXP02JEAVK.51.26.C04.1.454.CMB.2.raw
  modified_base (272)..(272): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagattaagttggggtactaagtattggtttcgtggtatcaacatcacccnggcccgtccccgatactgctcctctatcatgatgccaagccggccctcgagggactccccgtgacgcgtacttcctcgtcggcctaccaacgttcgtcgggggaccacgacggacccactctacgacccacgtcccggacccgggaccccgagggcccttgggtagacgtggacggtcctacggtaccttaagttaaccgttcggtacggtaacggggtcgggttacgggggaacgacggggggacgtcggtacgggtacggttaacggtttttccgggggacggggtaacggggtacccgtacgggttccgtacgggtaccccggttacgtaccggggtacccgaaccggtaccccggaacggtcccgttaccccggtccccccggttcgggtaccctacccgttccgtttaccccccgg

SEQ ID NO: 374965 - DNA, 592 bp, Homo sapiens
  misc_feature: GZ8MTXP02JUO0N.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataagttggggtctaagtattgtttcgtggtatcaacatcacccaggccggtccccgatactgctcctctatcatgatgccaagccggccctcagggactccctgagcgacttctctggcctccaactctcgggggacacacgccactctcgacccacgtcccggcggactccgaggtccgtggtggagtggaggtcgtagtaacttacttacgtggtacgacgggcgggtagggacgaggggaggcgtggccgttaggtttcggggacggacggggtaccgtaggtcgtacggacccggttaccgtacgggtaccgacggaacccgaacggtccgtcccgcccccgtcggtccgtaccgtttccccg

SEQ ID NO: 374966 - DNA, 614 bp, Homo sapiens
  misc_feature: GZ8MTXP02I30VN.51.26.C04.1.454.CMB.2.raw
  modified_base (258)..(258): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtcgtggggaggcgtggtccagcctgggaggtccctcagactctcctgtgcagcctctggcttcaccttcgactaacttttaatatgcactgggtgcgccgggctccaggcaaggggctggagtgggtgctgtatacttngatggaggtacaacatattactcagacgccgtgagggccgatcacatctccagagacaattccgggaacacactgtctctgacaaatcgaaacagcctagagagctggagacagggcttgtttattactgtgtgcgatccgacctcacgtggtacggggattactcctcgacgaacggtatcggacgtcgtcgggggaccaaacgggacccgaacggtccgaaccggttccttacccgttaacgccccttacccgaacccgaaacggggcccctaacgttcccgggttcccttcccccgtcggaccctaacccccgttcccacccaaacggacgacccaccgttcggtaccggggg

SEQ ID NO: 374967 - DNA, 515 bp, Homo sapiens
  misc_feature: GZ8MTXP02FI8Q7.51.26.C04.1.454.CMB.2.raw
  modified_base (395)..(395): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgtttcgtggtatcaacatcacccaggccggtcccccgatactgctcctctatcatgatgccaagcggccctcaggggatcccctgagcgattctctggctccaactctgggggacacagccactctgacccatcccgcgggacccaggctgngatgagctgactagttactgtcaggcgtgggacagggagctgcgatttcggcggagggaccagtccgtgaccgtccgtaggtccagcccaaggcctcgccccctcggtcacctcgtcccg

SEQ ID NO: 374968 - DNA, 586 bp, Homo sapiens
  misc_feature: GZ8MTXP02JOFHW.51.26.C04.1.454.CMB.2.raw
  modified_base (410)..(410): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgttcgtggtatcaacatcacccaggcccggtccccgatactgctcctctatcatgatgccaagcggccctcgagggactccctgacgtcgacttctcgtggccttccaaactcgtggggaccacgaacgcccactctgacccagtcccgcgggacccagggctacgnggatggaggctgactattactgtcgaggcgtggggacaggggaggcgtgcggtagttttcgggacgggacggggtaccgaggttcgtacggtaacccggttccgtacgggtacgacggacccgaaagggccttaccgggaccccccttcgggtccctaccgttccgtttcccccgg

SEQ ID NO: 374969 - DNA, 566 bp, Homo sapiens
  misc_feature: GZ8MTXP02G5J9J.51.26.C04.1.454.CMB.2.raw
  modified_base (257)..(257): a, c, t, g, unknown or other
  modified_base (526)..(526): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttatacttntgatggagtacacatatactcagacgcgtgagggccatcaccatctccagagacaagttccggaacacactgtctctgacaaatcgaacagcctgagagctggaggacagggtcttgtttatactgtgtgcgatccgactcacgtgggtacgggtattactccgtcgacgaacggtatcggacgtcgtcggggaccaagggaccacgggtcaccggtcctccgtacgccctaccaccgaacgggccccagtccggttcccttcccccgnggacccaacccgtccaccgaagcgccaccgtcggacgggg

SEQ ID NO: 374970 - DNA, 561 bp, Homo sapiens
  misc_feature: GZ8MTXP02IW90D.51.26.C04.1.454.CMB.2.raw
  modified_base (295)..(295): a, c, t, g, unknown or other
  modified_base (379)..(379): a, c, t, g, unknown or other
  modified_base (447)..(447): a, c, t, g, unknown or other
  modified_base (454)..(454): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagattaagtttggggtctaagtattgtttcgtggtatcaacatcacccaggcccggtcccgatactgctcctntatcatgatgccaagccggccctcgagggactccctgagcgtacttctctcggctccaactcgtggggacacgacgccactctnacccacgtccggccggacccaggcctgtggatggacgctgacttattactgtcgaggcggtgggacgngggaggngtggcgtagtttcgggcgggacgggaccgaggtcgtcggacgaacggttccgtacggtcgacggaacccgaacggccgtcgcccccgtcggtcctaccgtttccccg

SEQ ID NO: 374971 - DNA, 571 bp, Homo sapiens
  misc_feature: GZ8MTXP02IRVE1.51.26.C04.1.454.CMB.2.raw
  modified_base (177)..(177): a, c, t, g, unknown or other
  modified_base (375)..(375): a, c, t, g, unknown or other
  modified_base (415)..(415): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtcccgtgtccccaggacagacagccacatcacctgctctggagattaagtttggggtactaaggtattggtttcgtggtatcaacgtcacccgaggccggtccccgatactgctcctctatcatgatgccaagccggccctcgagggactcccctgagcgtattccctcgtggcctaccaactcgtcggggacncgacgccactctacgaccactccggcggacccaggctggnggatggagctagactattacgtgtccaggggtcgtagggacgaaggggcgcgtggcgtaggtttcgggcggagggacccaggtcgcggacccgttccgtaggtcgacgacccaaggccgtccgtcccccgtcggtccacgttcctccgttaccccc

SEQ ID NO: 374972 - DNA, 608 bp, Homo sapiens
  misc_feature: GZ8MTXP02IOH8Z.51.26.C04.1.454.CMB.2.raw
  modified_base (257)..(257): a, c, t, g, unknown or other
  modified_base (278)..(278): a, c, t, g, unknown or other
  modified_base (304)..(304): a, c, t, g, unknown or other
  modified_base (307)..(307): a, c, t, g, unknown or other
  modified_base (368)..(368): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaagggctggagtgggtgctgttatacttngatggagtacaacatattacncagacgccgtgaggggccattcaccntcncagagacatccggaacacactgtctctgacaaatcgaacagcctagagacgctgggagacnggggtcttgttttatacgtgtgtgcgtactcccgacctcgtaacgttcggggtacggggtagtttaccgttcctccgacgtaaccggttgtcggacgttccgtcgggggacccgaagggacccgacggtcaccgttcctcccgtacgtccctaccgaccgtaacgggccctacgtcccggtcccttcccccgtggccctaacccctcccgtaccaaacgcgcctacccgtcggtacgggg

SEQ ID NO: 374973 - DNA, 614 bp, Homo sapiens
  misc_feature: GZ8MTXP02HEXIO.51.26.C04.1.454.CMB.2.raw
  modified_base (600)..(600): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataagttgggtctaagtatgttcgtggtatcaacatcaccacggccgtccccgatactcgctcctctactcatgatgccaagccggccctcgagggactcccgtgacgtcgtacttccgtcctgggtcctccctaactcgtcgggggaccacacgcccactctacgacccactcccggacccgggacccacgggcgtggtggagtaggacggtacgtaggtacttaagttacgttaggtccgaggggtccggtggggaaccggaaggggacggccgtggtacggtacggtttcgggacggggacggtaccggacgttcgacgtaaccggtcgtacggtaccacggtacccaaggtccgtccgcccccgtcggtccncgttccttccccgg

SEQ ID NO: 374974 - DNA, 513 bp, Homo sapiens
  misc_feature: GZ8MTXP02IC0PQ.51.26.C04.1.454.CMB.2.raw
  modified_base (356)..(356): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggctaagtatgtttcgtggtatcaacatcacccaggccggtccccgatactgctcctctatcatgatgccaagcggccctcagggatcccctgagcgattctctggctccaactctggggacncagccactctgaccactccgcgggacccaggcctgtggatgagctgactattactgtcaggcgtgggacgagggaggctgcgtagtttcggcggaggaccagtctcgaccgtccgtaggtccagcccgaaggcctcgcccctcggtccactctcccg

SEQ ID NO: 374975 - DNA, 599 bp, Homo sapiens
  misc_feature: GZ8MTXP02GM7Z3.51.26.C04.1.454.CMB.2.raw
  modified_base (405)..(405): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggaggaggcgtggtccagcctgggaggtccctcagactctcctgtgcagcctctggcttcaccttcgacaacttttaatatgcactgggtgcgccgggctccaggcaaggggctggagtgggtggctgttataacttctgatggaggtacaacatattactcagacgccgtgaggggccgattcacatctccagagacaattccgggaacacactgtctctgcaaatgaacagcctgacgagctgaggacagggctgtttatactgtgtgcgatccgaccctnacgtgggtacggggtagttacttccgtccgcgaaacggtagtcgggacgttcggtcgggggacccaaagggggaccctacggggtccaacccggttcctccgttacgcccttacccgaccgaaacgggccccacgtccggtcccttcccccgtggccctaccctccctaccgaacgacgaccgtaccttccggg

SEQ ID NO: 374976 - DNA, 605 bp, Homo sapiens
  misc_feature: GZ8MTXP02HYFB3.51.26.C04.1.454.CMB.2.raw
  modified_base (263)..(263): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaacttttaatatgcacgtgggtgcgccgggctccgaggcgaaggggctggagtgggtgctgttatacttcngatggaggtacaacatatactcagacgccgtgaggggccgattcaccatctccagagacaagttccgggaacacactgtctctgacaaatcgaaacagcctagagagctggaggacaggggcttagtttatactgtgtgcgatccgacctcacgttggggtacggggtagttaccttccgtccgacgaacggttatcgggtacgtcggtaggggacccgaagggacccacggtcaccggtcctccgttaacgcctaccaccgaacgggcccacgttccggtcccttcccccgtcggaccctaacccctcctaaccgaacgaccgcctaaccttcggccgggg

SEQ ID NO: 374977 - DNA, 612 bp, Homo sapiens
  misc_feature: GZ8MTXP02GNDIY.51.26.C04.1.454.CMB.2.raw
  modified_base (212)..(212): a, c, t, g, unknown or other
  modified_base (259)..(259): a, c, t, g, unknown or other
  modified_base (279)..(279): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtncgccgggctccaggcaaggggctggagtgggtggctgttataacttngatggagtacaacatatacncagacgcgtgagggcgatcacatctcagagacaattccggaacacactgtctctgacaaatcgaacagcctgagagctgaggtacagggcttgtttattacgtgtgtgcgtactccgactcgacgtgggtacggggtacgttaccttccgtccgacgtaacggtagtcgggtacgtcgtcggggaccgaacgggaccgacggtcaccgtccgtaccttacgccctaccgaacccgaacgggcccctaacgttcccggttaccgttcccccgtcgggtaccctaacccccgtccctaccgaaaacgacgacccgtaacccgtcggtcccggggg

SEQ ID NO: 374978 - DNA, 539 bp, Homo sapiens
  misc_feature: GZ8MTXP02HBOD9.51.26.C04.1.454.CMB.2.raw
  modified_base (331)..(331): a, c, t, g, unknown or other
  modified_base (510)..(510): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggcttcaggcaaggggctggagtgggtggctgttataacttctgatggaggtacaacatattactcagacgccgtgagggccgattcaccatctccagagacaattccgggaanacactgtctctgacaaatgaacagcctgagagctgagacagggcttgtttatactgtgtgcgatccgactcgacttgggacgggtagttaccttcctccgactaacggtatggacgtcgtaggggaccaagggccacggtcaccgtctcgtagcctcacgaggcccatcgtcctcccgngccaacccgtcacagcgcaccgtcgcggg

SEQ ID NO: 374979 - DNA, 586 bp, Homo sapiens
  misc_feature: GZ8MTXP02ICDNZ.51.26.C04.1.454.CMB.2.raw
  modified_base (260)..(260): a, c, t, g, unknown or other
  modified_base (307)..(307): a, c, t, g, unknown or other
  modified_base (355)..(355): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtgctgttataacttcngatggaggtacaacatatactcagacgcgtgagggccattcacatcncagagacattccggaacacactgctctgacaaatcgaacagcctgagngctggaaggacaggggtcttgtttattacgtgtgtgcgtatccgacctcgacgtggggtaacgggtagttaccttccgtccgtacgaacggttatcgggtacgtcggttcgggggaccgaaaggggaccgtacggtaccaccggttctccttacgccctacccacgacggccctagtccggtccttcccccgtggccctaacccgtcctaccacgacgccacgtcgcgggg

SEQ ID NO: 374980 - DNA, 510 bp, Homo sapiens
  misc_feature: GZ8MTXP02HU86Y.51.26.C04.1.454.CMB.2.raw
  modified_base (353)..(353): a, c, t, g, unknown or other
  modified_base (382)..(382): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataagtttggggtctaagtatgtttcgtggtatcaatatcaccaggccgtccccgatactgctcctctatcatgatgcaagcgccctcagggatccctgagcgattctctggctcactctggggacacngccactctgacccatccgcggcccaggcngtgatgagctgactattactgtcaggcgtgggacaggggagcgtgcgtagtttcgggcggtaggacaggtctcggaccgtcgtacgtcacgcccgaaggctccgcccctcggtccaccttcttcccgg

SEQ ID NO: 374981 - DNA, 529 bp, Homo sapiens
  misc_feature: GZ8MTXP02IJNP0.51.26.C04.1.454.CMB.2.raw
  modified_base (224)..(224): a, c, t, g, unknown or other
  modified_base (431)..(431): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctgganataattggggtctaagtatgtttcgtggtatcaacatcacccaggccggtccccgatactgctcctctatcatgatgccaagcggccctcagggatcccctgagcgacttctctggctccaactctgggggacacgacgccactctgacccatccgcggacccaggctgtggatgagctagactattactgtcgaggcgtgggacgngggaggctagcgtagtttcggcggagggcagtcgtacgaccgtaccgtacggtcacgcccgaaggccgtacgcccccgtcggtccaccgtcttcccgg

SEQ ID NO: 374982 - DNA, 581 bp, Homo sapiens
  misc_feature: GZ8MTXP02GRQN7.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggctgttatactgtgtgcgatccgacctcacgtgggtacggggagttacttcctccgacaacggtatcggacgtcgtcggggaccgaagggaccacggtcaccggtctccgtacgccctccaccgacgggccctacgtccggttcccttcccccgtcggccctaaccccgtccctacccaaacgacgcctacccgtcggtaccggggg

SEQ ID NO: 374983 - DNA, 519 bp, Homo sapiens
  misc_feature: GZ8MTXP02GA7EB.51.26.C04.1.454.CMB.2.raw
  modified_base (447)..(447): a, c, t, g, unknown or other
tcagcgatcgtatacacgaccggtgctcgatttagtctagcgactttgggtttgggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgtttcgtggtatcaacatcacccaggccggtccccgatactgctcctctatcatgatgccaagcggccctcagggatcccctgagcgattctctggctccaactctggggacacagccactctgaccatccgcggacccaggctgtggatgaggctgactattactgtcaggcgtgggacaggggaggctggcgtagtttcgggngggtacgggaccgaggtccgtgaccgtccgtacggtcacgcccgaaggctcgccccgtcggcacctctcccg

SEQ ID NO: 374984 - DNA, 609 bp, Homo sapiens
  misc_feature: GZ8MTXP02G677E.51.26.C04.1.454.CMB.2.raw
  modified_base (563)..(563): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgtatacttctgatggaggtacaacatatactcagacgccgtgaggggccgattcaccatctccagagacaattccgggaacacactgtctctgcaaatcgaacagcctgagagctggaacgggacgagggtcttagtttaacttacgtgtcgtgacgtactccgacgtcacgttcggggtacgggtacgttaacttcccgtccgacgtaacggtagtacgggtacgtacggtaggggaccgaaacggggaccacgggtacaccgtcttacccgttagccctaccgaccgaacggccctagtccgtccttcccccgnggaccctaacccttccaccgaaacgcgacctaccgtcggtccgggg

SEQ ID NO: 374985 - DNA, 577 bp, Homo sapiens
  misc_feature: GZ8MTXP02HVEI4.51.26.C04.1.454.CMB.2.raw
  modified_base (221)..(221): a, c, t, g, unknown or other
  modified_base (407)..(407): a, c, t, g, unknown or other
  modified_base (442)..(442): a, c, t, g, unknown or other
tcagcgatcgtatacacgaccggtgctcgatttagtctagcgactttgggtttgggctgagcgtggtttccgtcgttaggctctttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggntccaggcaaggggctggagtgggtggctgttataacttctgatggaggtacaacatattactcagacgccgtgaggggccgattcaccatctccagagacaattccgggaacacactgtctctgacaaatgaacagcctgagagctggaggacaggggctgtttattatgtgtgcgatccgacctnacgtggtacgggtagttcttcctcgctaaacggtntgggtcgttcgggcggggaccgaacgggaccgacggtccgccgtcctccgtacgcctaccaccgaccggaccgtacgtccgttcccgttccccgtccgcctaaccctccctaccacgacgccgaccgtcggtcgg

SEQ ID NO: 374986 - DNA, 553 bp, Homo sapiens
  misc_feature: GZ8MTXP02HVDK4.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctggaggaggcgtggtccagcctgggaggtccctcagactctcctgtgcagcctctggcttcaccttcgacaactttaatatgcactgggtgcgccgggctccaggcaaggggctggagtgggtggctgttatacttctgatggagtacaacatattactcagacgccgtgacggggccattcaccatctccagagacaattccgggaaacacactgtctctgacaaatgaacagcctgagagctgagacaggggtctgtttattactgtgtgcgatccgactcacgttggtacggggtattactcgtccgctaacggtatggacgtcgtgggacaagggccacggtcaccgtctcgttacgccttaccgacgaacggcccagtccggtaccttccccgtgcccaccctctaccgacgtacgcctacgtccgg

SEQ ID NO: 374987 - DNA, 623 bp, Homo sapiens
  misc_feature: GZ8MTXP02F9WXH.51.26.C04.1.454.CMB.2.raw
  modified_base (255)..(255): a, c, t, g, unknown or other
  modified_base (267)..(267): a, c, t, g, unknown or other
  modified_base (275)..(275): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaagggctggagtgggtgctgtatacttngatggagtacanatattacncagacgccgtgaggggccgattcaccatctccagagacaattccgggaaacacactgtctctgacaaaatgaaacagcctgagagctgaggacagggctgtttatactgtgtgcgactccgactcacgtgggtacggggacgttacttccgtccgacgaaacggtatcgggtacgtcgtacgggggacccaaacgggggacccacggggttccaacccggttcctacccgtttaacgcccttacccgaaacccgaaacggggccccctaagttcccgggttccctttccccccgtcggaccctaaccccgtcccctaccgaaaacgcgaccacccgtcggtccggggg

SEQ ID NO: 374988 - DNA, 563 bp, Homo sapiens
  misc_feature: GZ8MTXP02GFUK5.51.26.C04.1.454.CMB.2.raw
  modified_base (442)..(442): a, c, t, g, unknown or other
  modified_base (552)..(552): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggaggaggcgtggtccagcctgggaggtccctcagactctcctgtgcagcctctggcttcaccttcgactaacttttaatatgcacgtgggtgcgccgggctccaggcaaggggctgggagtgggtggctgttatacttctgatggaggtacaacatattactcagacgccgtgaggggccattcacatctccagagacaattccgggaacacgactgtactctgcaaatgaacagcctgagagctgaggacgagggcttgtttatactgtgtgcgatccgacctcacgtggtacggggtattactccgtcgacaaggtntggacgtcgtgggccgaagggaccacggtcaccgtctaccttacgccctccgaccgaacgggtcccactcccgggttccttcccccgtggcccaccctcctaccaagacnccacctccggg

SEQ ID NO: 374989 - DNA, 566 bp, Homo sapiens
  misc_feature: GZ8MTXP02IQ0QS.51.26.C04.1.454.CMB.2.raw
  modified_base (526)..(526): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtggctgttataacttctgatggaggtacaacatatactcagacgccgtgaggggccattcaccatctccagagacaattccgggaaacacactgtctctgacaaatgaaacagcctgagagctgaggacaggggcttgtttatactgtgtgcgatccgacctcacgtgggtacggggtattacttcctccgactaacggtatggtacgtcgtggggaccaaagggaccacggtcaccgtctacctagccctccaccgacggccacgtccggtccttcccccnggccctaacccgtccctacacgacgccaccgtcgacgggg

SEQ ID NO: 374990 - DNA, 580 bp, Homo sapiens
  misc_feature: GZ8MTXP02JKBD9.51.26.C04.1.454.CMB.2.raw
  modified_base (180)..(180): a, c, t, g, unknown or other
  modified_base (189)..(189): a, c, t, g, unknown or other
tcagcgatcgtatacacgaccggtgctcgatttagtctagcgactttgggtttgggctgggcctcaggaagcagcatcggaggtgcctcagccatggcatggatccctctcttcctcggcgtccttgcttactgcacaggatccctggccgcctatgacctgactcagccaccctcagtntccggggtntccccaggacagacagccaccatcacctgctctggagattaagttggggtctaagtatgtttcgtggtatcaacatcacccaggcccggtccccgatacctgctcctctatcatgatgccaagcgccctcgagggactccctgacgcgtacttctctggctccaactcgtggggacacacgccactctcgacccatcccggaccgggacccagggctgtacggagtggaggtctagactattacgtgtcgaggcggtggggacgaggggaggcgtggcgtagttttcgggcgggagggtacccgtaggtccgtcggacccggttccgtaacggtccgacgaccccgtaaaggccttaccggcccccgtcggtaccctcgttccgtaccccg

SEQ ID NO: 374991 - DNA, 616 bp, Homo sapiens
  misc_feature: GZ8MTXP02I1PIT.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtggctgttataacttctgatggagtacaacatatactcagacgccgtgacgggcgattccaccatctccagagacaattccgggaacacactgtcctctgacaaatcgaacagcctagagagctggagacgagggtctgtttatactgtgtgcgatcccgacctcacgtcgggtaacggggtagtttaccttccgtccgtacctaaacgggtatcgggacgttccggtgggggacccgaaacggggacccgtacggggtcctaaccgtccgttacctacgccctccgaaccgaacggggccctagtccggttcccttcccccgtcggccctaaccctccctaccgaacggaccaccgtaccgtcggtcgggg

SEQ ID NO: 374992 - DNA, 558 bp, Homo sapiens
  misc_feature: GZ8MTXP02JFLMM.51.26.C04.1.454.CMB.2.raw
  modified_base (438)..(438): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgttcgtggtatcaacatcacccaggccggtccccgatactgctcctctatcatgatgcaagcggccctcagggatccctgagcgattctctaggctccaactctgggggacacgagacccactctacgacccatcccgccgggacccgacggccgtggtggaagtggaggcgtagacttattactgttcgagggngtggggacgagggaggcgtggcgagtttcgggcggtaaggggccaaggttccgtacggaccgtcgtacggttcacgacccgaaggccgtaccgcccccgtcggtccaccgtcttccccgg

SEQ ID NO: 374993 - DNA, 614 bp, Homo sapiens
  misc_feature: GZ8MTXP02HTMWE.51.26.C04.1.454.CMB.2.raw
  modified_base (201)..(201): a, c, t, g, unknown or other
  modified_base (259)..(259): a, c, t, g, unknown or other
  modified_base (314)..(314): a, c, t, g, unknown or other
  modified_base (374)..(374): a, c, t, g, unknown or other
  modified_base (376)..(376): a, c, t, g, unknown or other
  modified_base (599)..(599): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaanatgcactggggtgcgccgggctccgaggcgaagggctggagtgggtgctgttatactntgatggagtacaacatatactcagacgccgtggacggggcctattcaccattccnccagagactaacgttccgggaacacactgtctctgacaaatcgaaacacgctgagacggngnggagacgtaggtcttagtttactagtgtgtcgacgtactacccgacctcgtacggttacggggtacgggttacgttacccgttccgtaccgaacggtaacggtacgtacggtacgtcgggacgggaccgaacgggaccgacggtccaccgttctccgtacgccctaccgaccgaccggacctcgtcccgtccctcccgtcgaccctaacccgtccaccacgcnccgtaccgtcggcgg

SEQ ID NO: 374994 - DNA, 548 bp, Homo sapiens
  misc_feature: GZ8MTXP02FFDGI.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaagggggctgggagtgggtggctgttataacttctgatggaggtacaacatattactcagacgccgtgaggggccgattcaccatctccagagacaattccgggaacacactgtctctgcaaaatgaacagcctgagagctgaggacaggggctgtttatactgtgtgcgatccgacctcactggtacggggagttctcctccgcaacggtatggacgtcgtggggccaaggggaccacggtcaccgtctccttagcctccaccagggcccatcggtccttccccctggccaaccctcctccacgacgcacctcgcgggg

SEQ ID NO: 374995 - DNA, 600 bp, Homo sapiens
  misc_feature: GZ8MTXP02JXID4.51.26.C04.1.454.CMB.2.raw
  modified_base (354)..(354): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacngcctgagagctggaggacaggggcttgtttattactgtgtgcgactccgactcacgtcgggtacggggtagtttacctccgtccgacgtaacggtatcgggacgtcgtcgggggaccaacggggacccacgggtccaccgtccttcctacgtccctacccgaccgaacgggcccctagtccggttcccttcccccgtcggcccaaccccgtcctacccgaacgtaccgcctaccgtcgtccggggg

SEQ ID NO: 374996 - DNA, 569 bp, Homo sapiens
  misc_feature: GZ8MTXP02I86M9.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtggctgttatacttctgatggagtacacatatactcagacgccgtgaggggccattcacatctccagagacaattccgggaacacactgtctctgacaaatcgaacagcctagagagctgagacagggctgtttatactgtgtgcgactccgactcacgtgggtacggggattactccgtcgacgaacggtagtcggacgtcgtcggggaccaagggaccacggtcaccgtcctcctacgccctccaccgaagggccccagtcccggtcctcccccgtggccctaaccccgtcctaccgaacgacgcctacccgtcgtacggggg

SEQ ID NO: 374997 - DNA, 619 bp, Homo sapiens
  misc_feature: GZ8MTXP02JOKIG.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataagttggggtctaagtatgtttcgtggtatcaacatcacccaggcccggtccccgatactgctcctctatcatgatgccaagcggccctcgagggactccctgagcgtacttctctcggctccaactcgtgggggacctacgacgcccactctcgacccagtcccggccgggtaccccagggcctgggtacggagtggacggggtctacggaactttagttacgttggttccgaaggggtcgggtaggggacgtagggggaggcgtagggcgttaggtttccggggacggggtacggggaccgtaggttccgacggtacccggtacgtacggggtccacggacccgaacggggcctccgggcccccgtcggtccgtaccgttccgtttccccg

SEQ ID NO: 374998 - DNA, 763 bp, Homo sapiens
  misc_feature: GZ8MTXP02I24M3.51.26.C04.1.454.CMB.2.raw
tcagcgatcgtatacacgaccggtgctcgatttagtctagcgactttgggtttgggctgggcctcaggaagcagtatcggaggtgcctcagccatggcatggatccctctcttcctcggcgtccttgcttactgcacaggatccctggccgcctatcgacctgactcagccaccctcagtcgtccagtcccgacgacgacgacgacgaccacccaactactaccctacgtcgtccgtaggaaggtaattaaagttttaggggttacggtaagttaagttagtttcgttaggtatacaacaatcacccgaacggccgggtccccgtactactcgctcctaccttagtacagtagacgtacgaccgaaaccggccggtccccgtaacccggtagggtaaccgttaccccttccgggaagaccggttactttccccgtttcggtcggtacctaacctaaccctacggggttcggggaccgacaaccggaccgtacccttataccggaacccgaacgttcccggggacccggggaaacccccggttacggcggttacgggtaagggtacggtacggaacggtacgtacgttaacgttaacgtttaccggtacggacgggtaacggggtcgggaccggggtaaagggaggggacggtcggtacggtacggtacggttacgggtacgggtacgggtacggtacgtacgtacgtacgtacgtacgtacgacgacgacgcgccgccgtccgtccgtccgtccgtccgtccg

SEQ ID NO: 374999 - DNA, 569 bp, Homo sapiens
  misc_feature: GZ8MTXP02I5EV8.51.26.C04.1.454.CMB.2.raw
  modified_base (448)..(448): a, c, t, g, unknown or other
  modified_base (551)..(551): a, c, t, g, unknown or other
  modified_base (557)..(557): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaacttttaatatgcacgtgggtgcgccgggctccaggcgaaggggctggagtgggtgctgttataacttctgatggaggtacaacatattactcagacgccgtgacggggccattcacatctccagagacaattccgggaacacactgtctctgacaaatgaaacagcctagagagctgaggacagggcttagttattactgtgtgcgactccgactcacgtgggtacgggtattacctccgtccgactaacggtntagggacgtcgtgggaccaagggaccacggtcacgtctccgtacgcctaccgacgaacggccacgtccgttcctccccgtgaccctaacccgtcctacgaacncgaccnccgtcgacgggg

SEQ ID NO: 375000 - DNA, 549 bp, Homo sapiens
  misc_feature: GZ8MTXP02H6558.51.26.C04.1.454.CMB.2.raw
  modified_base (304)..(304): a, c, t, g, unknown or other
  modified_base (332)..(332): a, c, t, g, unknown or other
  modified_base (430)..(430): a, c, t, g, unknown or other
  modified_base (538)..(538): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaacttttaatatgcactgggtgcgccgggctccaggcaaggggctggagtgggtggctgttatacttctgatggagtacaacatatactcagacgcgtgagggccatcacanctcagagacaatccggaacacactgtcnctgacaaatgaacagctgagagctgaggacagggtcttagttatactgtgtgcgatccgactcacgtggacgggattacgtcctccgactaacggtanggtacgtacgtggggaccaaggggacccacgggtcacccggtctcccgtagccctaccaccgtaagggccctagtccgtccctcccctgcccaacctccaccagaccncaccgtcgcgg

SEQ ID NO: 375001 - DNA, 528 bp, Homo sapiens
  misc_feature: GZ8MTXP02FRCAJ.51.26.C04.1.454.CMB.2.raw
  modified_base (289)..(289): a, c, t, g, unknown or other
  modified_base (418)..(418): a, c, t, g, unknown or other
  modified_base (422)..(422): a, c, t, g, unknown or other
  modified_base (504)..(504): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgtttcgtggtatcaacatcacccaggccgtccccgatactgctccnctatcatgatgccaagcggccctcagggactccctgagcgacttctctggctccaactcgtggggacacacgccactctcgaccacgtcccgccgggacccaggcctgtggatgaggctgactattacngtcnggcgtggggacaggggagcgtggcgtagtttcgggcgggtagggaccaggtctcgaccgtcgtaggtcgacgccgaaggccncggccccctggtccacgtctcccg

SEQ ID NO: 375002 - DNA, 580 bp, Homo sapiens
  misc_feature: GZ8MTXP02GBGW6.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgtttcgtggtatcaacatcacccaggcccggtccccgatactgctcctctatcatgatgccaaggccggccctcgagggactccctgagcgacttctctggctccaactcgtcggggacacacgcccactctcgaccacgtcccggccgggacccaggctggtcggatggaggctgactagttactgtcgagggtcggtaggggacgaggggacggtcgtggtcggtagtttcggggacgggtacgggtaccgtaggtccgtcggtacccgtcgtacggtaccgacggacccgaaggtccctccggcccccgtacggtcctaccgtccgtttccccg

SEQ ID NO: 375003 - DNA, 605 bp, Homo sapiens
  misc_feature: GZ8MTXP02GRPFU.51.26.C04.1.454.CMB.2.raw
  modified_base (250)..(250): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtcccttgcttactgcacaggatccctggccgcctatgacctgactcagccaccctcagtgtccgtgtccccaggacagacagccaccatcacctgctctggagataattgggtctaagtatgtttcgnggtatcaacatcaccaggcccgtcccgatactgctcctctatcatgatgccaagccgccctcagggactcccgtgagtcgacttctctggcctccgaactcgtgggggacacgacgcctactcgtcgacccacgtcccggaccggacccgtaggcctggtgagtcgaggctacgtactagttactgtcggtgggtcggtagggacggaggggacggtcgtcggtacggttacggtttcggggacggggtacggtaccgtacggtacgtaccggtacccggtacggtacggtaccgtaccggacccggaacggtcccgtcccggtaccccgtccgtacctaccgttcccgttcccg

SEQ ID NO: 375004 - DNA, 585 bp, Homo sapiens
  misc_feature: GZ8MTXP02GE43O.51.26.C04.1.454.CMB.2.raw
  modified_base (259)..(259): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttngatggaggtacaacatattactcagacgccgtgaggggccatcaccatctccagagacaattccgggaacacactgtctctgacaaatcgaacagcctgagagctggaggacgagggcttgtttaattactgtgtgcgatccgactcgacgtgggtacggggtactttacgtccgtccgacgtaacggtagtgggtacgtcggtacggggaccaagggacccacggtcaccgtcttccgtacgccctaccgaccgacgggccctagtccggtcccttcccccgtggacccaaccccgtctaccaacgacgccaccgtcgtcggggg

SEQ ID NO: 375005 - DNA, 559 bp, Homo sapiens
  misc_feature: GZ8MTXP02IPZ90.51.26.C04.1.454.CMB.2.raw
tcagcgatcgtatacacgaccggtgctcgatttagtctagcgactttgggtttgggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagataattggggtctaagtatgtttcgtggtatcaacatcacccaggccggtccccgatacctgctcctctatcatgatgcaagccggccctcgaggactccctgagcgtacttctctgcctccaactctcggggacacacgcccactctcgaccacgtccgcccggacccaggcctggtggagtggaggctagtactattacgtgtcgtaggcggtgggacgaggggagcgtggcgtagtttcgggcggtacggacgtaggtctcggtaccgtccgtacggtccgacgtacccgaacggtccctcggcccccgtcggtccgtaccgtcgtttccccgg

SEQ ID NO: 375006 - DNA, 685 bp, Homo sapiens
  misc_feature: GZ8MTXP02GWHOR.51.26.C04.1.454.CMB.2.raw
  modified_base (257)..(257): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttatacttntgatggaggtacaacatattactcagacgccgtgagggccgatcacatctccagagacaattccggaacacactgtctctgacaaatcgaacagcctgagagctggagacagggcttagtttatactgtgtgcgtactccgactcacgtcgggtacggggtacgttaccttcccgtccgtacgtaaaccggttagtcgggtacgtcggttacgggggacccgaaacgggggtacccaaccggggttacccgtaaccccggttccgttacccgtttaaccggtcccccgttaaccccgaaaccccggtaaaccgggggaccccctaaacggttccccgggtttccccttcccccccgtcgggtacccctaacccccgttaccccgtacccgtaaaacgaccgtacccgtacccgtaccggtcccggggg

SEQ ID NO: 375007 - DNA, 542 bp, Homo sapiens
  misc_feature: GZ8MTXP02IFHSU.51.26.C04.1.454.CMB.2.raw
  modified_base (258)..(258): a, c, t, g, unknown or other
  modified_base (409)..(409): a, c, t, g, unknown or other
  modified_base (436)..(436): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagataattggggtctaagtatgtttcgtggtatcaanatcaccaggccgtccccgatactgctcctctatcatgatgcaagcgccctcagggactcccctgacgcgacttctctggctcaactctcgggggacacagccactctgaccactccgcggacccaggctgtggatgaggctagctaattcntcgagcgtgggacgaggaggcgtgcgngttcggtcgggacgggtaccgaggtcgtacgtaccgtccgttacggtacgacgacccgaaacggccgaccgtaccccgtcccgggtccgtaccgtccgtttccccg

SEQ ID NO: 375008 - DNA, 540 bp, Homo sapiens
  misc_feature: GZ8MTXP02HYRLO.51.26.C04.1.454.CMB.2.raw
  modified_base (448)..(448): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggcccggtccccgatactcgctacctctatcatgatgccaagcggccctcgagggactccccgtgacgcgacttctcgtgctccaacgtctcggggacacacgcccaactctacacccatcccgcggacccaggctgtgatgaggctgactattacgtgtcgaggcgtgggacgaggggngcgtggcgttaggttcgggacgggacggtacgaggtcgcgtccgtacgtacgcgacgaccgaacgccgtccgcccgtcgtcctccgtctccg

SEQ ID NO: 375009 - DNA, 569 bp, Homo sapiens
  misc_feature: GZ8MTXP02FL4OT.51.26.C04.1.454.CMB.2.raw
  modified_base (533)..(533): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtggctgttataacttctgatggaggtacaacatattactcagacgccgtgaggggccgatcaccatctccagagacaattccgggaacacactgtctctgacaaatcgaacagcctgagagctgaggacaggggcttgtttatactgtgtgcgatccgactcacgtgggtaggggtacccccttatccctccgacgaacggtatggacgttcgtggggaccaacgggaccacgggtcaccgtctccttacgccctaccaccgaacgggcccagtccggtccttccccgngcccaaccctcctaccacgcgccaccgtcgtcgggg

SEQ ID NO: 375010 - DNA, 564 bp, Homo sapiens
  misc_feature: GZ8MTXP02JW0R8.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgtttcgtggtatcaacatcacccaggcccggtccccgatactgctcctctatcatgatgccaagcgccctcgagggactcccgtgagcgattcctcgtggcctccaactcgtcgggggacacacgccactctcgacccactcccgacgggacccagggcctgtgagtgaggctgactattatgtcgaggcggtgggacgagggaggcgtggcgtagtttcgggcgggtacgggaccgtaggttccgcggtacccgttacgtacggtccacgacccgaacggccgtccggcccccgtacggtcctaccgttccgttccccgg

SEQ ID NO: 375011 - DNA, 650 bp, Homo sapiens
  misc_feature: GZ8MTXP02JFOR8.51.26.C04.1.454.CMB.2.raw
  modified_base (178)..(178): a, c, t, g, unknown or other
  modified_base (282)..(282): a, c, t, g, unknown or other
  modified_base (416)..(416): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacagggatccctggccgcctatgacctgactcagccaccctnagtgtccgtgtccccaggacagacagccaccatcacctgctctggagataagttggggtctaagtatgttcgtggtatcaacatcaccaggcccgtcccatacngctcctctatcatgatgccaagcggccctcgaggtactcccgtgacgcgtacttctcgtcggcctccgaaactcgtcgggggaccacgacgccactctacgacccacgtcccgccggacccaggctggtggacnggacggtctagacttagttacgtcgtacgacgggtcgtacggggaacgacgggggacggtcgtcggtacggtacggtttcggggacgggtacgggtacccgtaacggttccggtacggtacccggttaccggtacggtaccggtaaccggaccccggtaaacggggtcccgttaccccgggtaccccccggttccgggggtaacccttaccccgggttcccgtttacccccggg

SEQ ID NO: 375012 - DNA, 621 bp, Homo sapiens
  misc_feature: GZ8MTXP02IN08W.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagtattaagtttggggtactaagttattggtttcgtggtatcaacatccacccgaggcccggtccccgatactcgctcctctatcatgatcgccaagccggccctcgacgggactcccgtgacgcgtacttctcgtcggcctaccaacgttcgtcggggaccacgacgccctactcgacgtacccacgtcccggccgggacccgagggccgtggtaggagtggacggtcgtagtaacttagttacgtgtacgtagggaggtaggggaacgaggggacggtcggtcggacggttaggtttcgggacgggacgggaccgtacggtcgtacgtaccggtcgtacggtcgaccggacccgaacggtccgtccggtcccccgtcggtacctccgttccttcccg

SEQ ID NO: 375013 - DNA, 583 bp, Homo sapiens
  misc_feature: GZ8MTXP02H9UYV.51.26.C04.1.454.CMB.2.raw
  modified_base (328)..(328): a, c, t, g, unknown or other
  modified_base (440)..(440): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatatactcagacgccgtgaggggccgattcacatctcagagacaatccgggaanacactgtctctgacaaatgaacagcctagagagctgaggacaggggtcttgtttatactgtgtgcgactccgactcacgtgggtacgggtacttacttcctcgacaacggtntgggtacgtcgtcggggaccaaggggacccacggtccaccgttcctaccgttacgccctccgaaccgtacgggccctacgtccggtcccttcccccgtggccctaacccccgtcctacccacgacgccaccgttcggacgggg

SEQ ID NO: 375014 - DNA, 532 bp, Homo sapiens
  misc_feature: GZ8MTXP02IBM4L.51.26.C04.1.454.CMB.2.raw
tcagcgatcgtatacacgaccggtgctcgatttagtctagcgactttgggtttgggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgttcgtggtatcaacatcacccaggccggtccccgatactgctcctctatcatgatgccaagcggccctcagggactccctgagcgattctctggctccaactctggggcacagccactctgaccactccgcggacccaggctgtggatgagctgactattactgtcaggcgtgggacgagggaggcgtgcgtagttttcggcgggagggaccgagtcgtcggtaccggtccgtacggtcgacgacccgaaacgggccgttcgcccccgtcggtcctacgtcctttcccg

SEQ ID NO: 375015 - DNA, 612 bp, Homo sapiens
  misc_feature: GZ8MTXP02H89EQ.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatcgaacagcctgagagctgaggacaggggctgtttattactgtgtgcgtatccgacctcgacgtgggtacggggacgtttacttccctccgacgtaacggtatcgggacgtcgtcgggggaccaacggggaccacggtccgaccgttctacccgttacgccctaccgaccgtaaaccgggccctaacgttccggtcccttccccccgtcggaccctaacccccgtcccgtacccaaacggaccgacctaccgtcggtccggggg

SEQ ID NO: 375016 - DNA, 564 bp, Homo sapiens
  misc_feature: GZ8MTXP02FYV0M.51.26.C04.1.454.CMB.2.raw
  modified_base (257)..(257): a, c, t, g, unknown or other
  modified_base (386)..(386): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctgggagtgggtggctgtatactntgatggaggtacaacatattactcagacgccgtgaggggccgattcaccatctccagagacaattccgggaacacactgtctctgcaaatgaacagcctgagagctgaggacaggggctgtttattacngtgtgcgatccgactcacgtggtacggggagttactcctcgacaacggtatcgggacgtcgtggggaccaacgggaccacggtcaccggttctccttacgccctaccaccgaacgggcccagtccggtccttcccccgtggcccaaccctcctaccaacgcgaccacctcgtcggggg

SEQ ID NO: 375017 - DNA, 743 bp, Homo sapiens
  misc_feature: GZ8MTXP02ID762.51.26.C04.1.454.CMB.2.raw
  modified_base (265)..(265): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctggggaggtccctcagactctcctgtgcagcctctggcttcaccttcgactaacttttaatatgcacgtgggtgccgccgggctccaggcgaaggggctggagtgggtgcttgttatacttcngatggagtacaacatatactcagacgccgtggaggggcctatcaccatcctccagagacaagttaccgggaacacactgtctctgacaaatcgaaacagtccaggagacgcgtggaacggaacgagggggtctttaggttttaattacgtgtgttgcgtaactcccgacttacgacgttacggggtacggggtacgttaccttcccgtccgacgtaaaccgggttagtacgggtacgttcgggtacgggggaccctaaacgggggacccgtaaccggggttccaacccggttccttacccgttacgacccccttaccccgaaaccggtaaacccgggggcccccttaaacgggttccccgggtttaccccctttcccccccggttcggaccccccgtaaacccccccgtttcccctaaaccccggtaaaaccggaaccggtcccccttaaaccccggtttacggggtaccccgggggg

SEQ ID NO: 375018 - DNA, 575 bp, Homo sapiens
  misc_feature: GZ8MTXP02IA1KJ.51.26.C04.1.454.CMB.2.raw
  modified_base (263)..(263): a, c, t, g, unknown or other
tcagcgatcgtatacacgaccggtgctcgatttagtctagcgactttgggtttgggctgagctgggtttttcctcgttgctcttttaagaggtgtccagtgtcaggtgcacctggtggagtctgggggaggcgtggtccagcctgggaggtccctcagactctcctgtgcagcctctggcttcaccttcgactaacttttaatatgcactgggtgcgccgggctccaggcaaggggctggagtgggtggctgttataacttcngatggaggtacaacatatactcagacgccgtgagggccattcaccatctccagagacaattccgggaaacacactgtctctgacaaatcgaacagcctgagagctgaggacagggcttagtttatactgtgtgcgatcccgactcacgtgggtacggggacttaccgttcctccgacgaacggtgtcggacgtcgtggggaccgaaggaccgacggtccaccgtcctcctacgcccctccaccgaacggcctacgtcccggttccttcccccgtcgcccaacccgtccaccaacgcgccaccgtcgccgggg

SEQ ID NO: 375019 - DNA, 712 bp, Homo sapiens
  misc_feature: GZ8MTXP02H7PK4.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaactttaatatgcacgtggtgcgccgggctccaggcaaggggctggagtgggtggctgttataacttctgatggaggtacaacatatactcagacgccgtgagggccatcacatctcagagacatccggaacacactgctctgacaaatcgaacagcctagagagctgaaggacagggtcttagtttatactgtagtgcgtactcccgacctctacgttggggtaacggggttacgttaccctttcccgtaccgaccgtaaacgggttacgttcggggtaaccggttcggtaccgggggaacccgtaaacgggggaccccgtaaccgggttacccgaacccggttcccttacccgtttaacgcccccttacccgaaaaccccggtacggggaccccctaacggttccccggggttaccccctttacccccccggcgggtacccccctaaccccccgtttcccgtaaaccccgtaaacggtaaccgcccccgtaacccggtttcccgggaaccccgggggg

SEQ ID NO: 375020 - DNA, 631 bp, Homo sapiens
  misc_feature: GZ8MTXP02I14BD.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtgctgttatacttctgatggaggtacaacatattactcagacgccgtgaggggccgattcaccatctccagagacaagttccgggaacacactgtcctctgacaaatcgaacagcctgagagctggacggacgaggggtccttgtttaattactgtgtgcgatcccgacctcgacgttgggtacgggggtattaccttccgtccgacgtaaacggtagtcggggtacgttccggtgggggacccgaaaggggacccgaacgggtccgaacccgttcgttccgttacggccccttacccgaccgaaacggggcccctaacggtcccggttcccttcccccgtcggccctaaccccgtcctacccaaacgcgcccaccgtcgtcggggg

SEQ ID NO: 375021 - DNA, 585 bp, Homo sapiens
  misc_feature: GZ8MTXP02FOK1V.51.26.C04.1.454.CMB.2.raw
  modified_base (280)..(280): a, c, t, g, unknown or other
  modified_base (310)..(310): a, c, t, g, unknown or other
  modified_base (434)..(434): a, c, t, g, unknown or other
  modified_base (542)..(542): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtgctgttatacttctgatggagtacaacatattacncagacgcgtgagggccatcacatctcaganacaattccggaacacactgtctctagactaaatcgaaacagcctagagagctggagacgagggtcttagtttaactagtgtgtgcactccgactcgacgtcggggtacgggtactttacctccnccgacgtaaacggtagtcgggacgtcggtaggggaccaaacgggaccacggtcaccgtctaccgttacgccctaccgacaaacgggccctagtccggtccttccccgngacctaaccccgtcctacgaaacgcgaccaccgtcgacggggg

SEQ ID NO: 375022 - DNA, 634 bp, Homo sapiens
  misc_feature: GZ8MTXP02IU1R8.51.26.C04.1.454.CMB.2.raw
  modified_base (259)..(259): a, c, t, g, unknown or other
  modified_base (313)..(313): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttntgatggaggtacaacatatactcagacgccgtgagggccatcacatctccaganacaatccgggaacacactgtctctgacaaatcgaacagctagagagctgaggacagggtctagtttatactgtgtgcgtactccgacctcgacgtcgggtacggggtacttaccgttccctccgtaccgtaaacggtagtacgggacggttcgtcgggggaccgaaacggggacccgacgggtaccacccggttccttaccgttaccgccccttacccgaacccgaaccggggacccctaacgttcccgggtcccctttccccccgtggcccctaacccctcccgtacccaaacgacgaccctacccgtcggtaccggggg

SEQ ID NO: 375023 - DNA, 690 bp, Homo sapiens
  misc_feature: GZ8MTXP02JYXP1.51.26.C04.1.454.CMB.2.raw
  modified_base (409)..(409): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataagttggggtctaagtatgtttcgtggtatcaacatcacccgaggcccgtccccgatactgcctcctctatcatgatgccaagccggccctcgagggactccgtgagcgacttctctcggcctccaacttcgtcggggaccacgacgccactcgtacgacccacgtcccggaccgggaacccncgggtccgtggtaggtacgttgggaacgggtccttagtaaccgtttaacgtttaccgtacggttaccggagggggtaccgggttacgggggaaccgggtaagggggacggggtaccggttcggggtaccggttaacgggtttttccgggggaccggggaacggggtacccgtaacgggttccgtaccgggtacccggttaccggtacgggttaccgaccggtacccgaacggtcccgtcccggtacccccgttccggtccctaccgttccgtttcccccgg

SEQ ID NO: 375024 - DNA, 630 bp, Homo sapiens
  misc_feature: GZ8MTXP02IYNCC.51.26.C04.1.454.CMB.2.raw
  modified_base (220)..(220): a, c, t, g, unknown or other
tcagcgatcgtatacacgaccggtgctcgatttagtctagcgactttgggtttgggctgggcctcaggaagcagcatcggaggtgcctcagccatggcatggatccctctcttcctcggcgtccttgcttactgcacaggatccctggccgcctatgacctgactcagccacctcagtgtccgtgtcccaggacagacagccacatcacctgctctgganataatttggggtctaagtatgtttcgtggtatcaacatcacccaggccgtccccgatactgctcctctatcatgatgccaagcgccctcgagggactccctgagcgacttctctgcctcaacttcgtcgggggacacgacgccactcgtccaaccgactcccggaccggacccgacggcccttgggtcggagtcggaaggggtcctagggaacctttagttaaccgttggttacgaccggggtacgggttcgggggaaccgggaagggggaacgggtcggttacggcggttacggttttccgggggacggggtaacgggacccgaggttccgtacggacccgttccgtacggtaccgaccgacccgaacggcctcccggtccccgtcggtcctacccgtcgtttccccgg

SEQ ID NO: 375025 - DNA, 644 bp, Homo sapiens
  misc_feature: GZ8MTXP02HECRN.51.26.C04.1.454.CMB.2.raw
  modified_base (262)..(262): a, c, t, g, unknown or other
  modified_base (355)..(355): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggcccagcctgggaggtccctcagactctcctgtgcagcctctggcttcaccttttgactaactttaatatgcactgggtgcgccgggctccaggcaaggggctggagtgggtggctgttataacttcngatggaggtacaacatatactcagacgccgtgaggggccatcacatctccagagacaagttccgggaacacactgtctctgacaaatcgaacngcctgagagctgaggacgagggtcttagtttatacgtgtgtgcgtactccgactcgacgttcgggtacgggtagttacctccgtccgacgaacggttagtcgggtacgtcgtcgggggaccaacggggaccctacggggtacctaccggtcttccgttacgcccgtacccgaaaccgaacggggtaccccctagtacccgggttcccttcccccgttcggacccctaacccccgttccctaaccccggaaaacggtcccgacccgttaaccccggtacccgggggaccc

SEQ ID NO: 375026 - DNA, 668 bp, Homo sapiens
  misc_feature: GZ8MTXP02JZHJ4.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagataagttgggtctaagtatgttcgtggtatcaacatcacccagggcccggtccccgatactgcctcctctatcatgatgccaagccggccctcgacgggactccccgtgacgcgtattcctcgtcggcctaccaacgttcgtcgggggaaccacacggccctactccgtacgacccaccgtcccggacccggggaccccgacgggtccgtggtcgggagtcgggaacggtcgtagtaaccttagttaccgtggtacgaggggcggtaggggacgaggggaggtcgtgggtccgttaaggtttccggggacgggtaacggggtacccgtaggttccggtacggtaaccccggttccggtaaacgggtcccgaaccggtaccccggaacgggtccccgtacccggtcccccccggttcgggtccctacccgtttcccgtttcccccg

SEQ ID NO: 375027 - DNA, 563 bp, Homo sapiens
  misc_feature: GZ8MTXP02IRRLU.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccacccctcagtgtccgtgtccccaggacagacagccaccatcacctgctctggagataatttggggtctaagtattgtttcgtggtatcaacatcacccaggccggtccccgatacctgcctcctctatcatgatgccaagccggcccctcgagggactccctgagcgacttctctggctccaacctctcgggggacacacgcccactctcgacccacgtcccgccgggacccacggcgtggtggagtggaggctgacttattactgtcgaggcggtgggacgaggggaggcgtgcgtagtttcgggcggtacgggaccgaggtctcggaccgtccgtacggtccgacgacccgaaggccctcgcccccgtcggtcctaccgtccgtttcccg

SEQ ID NO: 375028 - DNA, 627 bp, Homo sapiens
  misc_feature: GZ8MTXP02JHIL4.51.26.C04.1.454.CMB.2.raw
  modified_base (418)..(418): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggccagcctgggaggtccctcagactctcctgtgcagcctctggcttcaccttcgacaactttaatatgcactgggtgcgccgggctccaggcaaggggctgggagtggggtggctgttataacttctgatggaggtacaacatatactcagacgccgtggaggggccgattcaccatctccagagacaattccgggaacacactgtctctgcaaatcgaacagcctagagagctgaggacagggtctgtttattactgtgtgcgactggggacctcgtacggngttacggggtacggttacgttaccgtacccgtaccgacgtaacggtcgtacggggtaccgtacggggtaccgggaccggaaccgggaccccgtacgggtccctacccggtcccttacccgtacgacccgtacccgccttaaccgggccctacggtcccgtcccttcccccgtcgcccgacccgtccaccgaacgccaccggtcctcggg

SEQ ID NO: 375029 - DNA, 541 bp, Homo sapiens
  misc_feature: GZ8MTXP02F9QAK.51.26.C04.1.454.CMB.2.raw
  modified_base (417)..(417): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagattaattggggtctaagtatgtttcgtggtatcaacatcacccaggccggtccccgatactgctcctctatcatgatgccaagccgccctcagggactcctgagcgacttctctggctccaactctgggggacacgacgccactctcgaccatcccggccggacccaggctgtggatgagctagactattacgngtcgaggcggtgggacgaggggcggcgtggcggtagtttcgggcgggtagggaccgagtcgtcgaccggttctacgggtccaggacccaacgggctccggccccctcggtcctcctcgtttccg

SEQ ID NO: 375030 - DNA, 647 bp, Homo sapiens
  misc_feature: GZ8MTXP02IH0PY.51.26.C04.1.454.CMB.2.raw
  modified_base (439)..(439): a, c, t, g, unknown or other
  modified_base (517)..(517): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtcgtccccaggacagacagccacatccacctgcctcgtggagtattaagtttgggggtacttaagttattggtttcggtaggtatacaactatccaccgacggcccggtccccgatactcgcctcctctatcatgatcgccaacggccggaccctcgagggactcccgtaggacgcgtacttcctcgtcggcctaccaacgtcgtcggggacacacgcccactcgtacgacccacgtcccggcccggaacccgngggtaccgtggtggacgtgggacggtcgtagtacttacgttacgtcggtacgagggtcgggtaggggacggagggggnggtcgtggtcggttacggttcggggacgggtacggtaccgtcggtccgtaccggtacccggtacgtacggtaccgaccgacccggtaacggtcccgtcccgtccccgtcggtccctaccgttccgtcccg

SEQ ID NO: 375031 - DNA, 568 bp, Homo sapiens
  misc_feature: GZ8MTXP02HMYDY.51.26.C04.1.454.CMB.2.raw
  modified_base (401)..(401): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttataacttctgatggaggtacaacatatactcagacgccgtgagggccatcacatctccagagacaatccgggaacacactgtctctgcaaatcgaacagctgagagctggaggacagggcttagtttatacgttgtgtgcgatccgacctnacgtgggtacgggtagttactcctccgacaacggtatgggtacgtcgtggggaccaagggaccacgggtcaccgtctccgttacgccctccaccgaacgggccctacgtccggtcccttcccccgtggaccctcccttccacccaagcgcctaccgtcgtccggggg

SEQ ID NO: 375032 - DNA, 619 bp, Homo sapiens
  misc_feature: GZ8MTXP02GJWA9.51.26.C04.1.454.CMB.2.raw
  modified_base (261)..(261): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtggctgttataacttcngatggaggtacaacatattactcagacgccgtgaggggccgattcaccatctccagagacaattccgggaacacactgtctctgacaaatgaacagctagagagctgaggacagggtctagtttattacgtgtgtgcgtatccgacctcgacgtgggtaacggggtacgtttaccgttccgtaccgcgtaaacggtacgtcgggacgtcggtacgggggacccgtaaagggcccgacggtccgaacccgtctaccgttacgccctccaccgaaacgggcccctaacgtccggtcccttcccccgtcggtacccaaccccgtccctacccgaacgcgacccgtaccgtccggtcggggg

SEQ ID NO: 375033 - DNA, 517 bp, Homo sapiens
  misc_feature: GZ8MTXP02HLPH6.51.26.C04.1.454.CMB.2.raw
  modified_base (412)..(412): a, c, t, g, unknown or other
  modified_base (420)..(420): a, c, t, g, unknown or other
  modified_base (428)..(428): a, c, t, g, unknown or other
  modified_base (430)..(430): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataagtttggggtctaagtatgttcgtggtatcaacatcacccaggccggtccccgatactgctcctctatcatgatgccaagcggccctcagggatccctgagcgatctctggctcaactctgggggacacatccactctgaccatccgcggaccaggctgtgatgaggctgactatactgtcaggngtcggganaggacggngngcgtgttcggtcggacggacgacgtcgtcgtacgtacgtacgtacgacgaccgaacgcgccgtcccgtccgtccgtaccgtcgtccg

SEQ ID NO: 375034 - DNA, 589 bp, Homo sapiens
  misc_feature: GZ8MTXP02JRKRV.51.26.C04.1.454.CMB.2.raw
  modified_base (260)..(260): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcacgtgggtgcgccgggctccaggcaaggggctggagtgggtgctgttataacttcngatggaggtacaacatattactcagacgccgtgaggggccgattcacatctccagagacaattccgggaacacactgtctctgacaaatcgaacagcctagagagctggaggacgagggtctagtttattactgtgtgcgtatccgactcgacgtgggtacggggtagttacttcccgtccgacgaacggttagcgggtacgtcggtacgggggaccgaaaggggacccacgggtccaccggtcctacctacgccctccaccgacggcccacgtccgtccttccccgcggcccaaccctcctaccacgacgcctaccgcggtaccgggg

SEQ ID NO: 375035 - DNA, 658 bp, Homo sapiens
  misc_feature: GZ8MTXP02G42VA.51.26.C04.1.454.CMB.2.raw
  modified_base (221)..(221): a, c, t, g, unknown or other
  modified_base (260)..(260): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtcccaggacagacagccacatcactgctctgganataagttggggtacttaagtatggtttcgtggtatcaanatcacccaggcccggtccccgatactcgctcctctatcatgatcgccaagccgccctcgacgggctcccgtgacgcgacttctctcggcctaccactcggtggggaccacgacgcctatttcgacgacctacgcccgaccggggaacccagggccgtggttagggagtacggaggggtacctaggtaacctttaacgtttacctagggttacccgagggggttcggtacgggggaaaccgagggggaacggtccgtgggtacggttacgggtttccgggggcggggttaacgggaccccgtaggtccgttacggaacccggtttccgtaacggtccgaaccggacccgaaggtcccgtacccggtccccccgtggtccctaccgttccgtttcccccg

SEQ ID NO: 375036 - DNA, 588 bp, Homo sapiens
  misc_feature: GZ8MTXP02GUTDW.51.26.C04.1.454.CMB.2.raw
  modified_base (260)..(260): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtggggtggctgttataacttntgatggagtacaacatattactcagacgccgtggacggggccgatcaccatctccagagacaagttccggaacacactgtctctgacaaatcgaaacagcctagagagctggagacgagggtcttgtttatactgtgtgcgatccgactcacgtgggtacggggtattacctccgcgacgtaacggtagtcgggtacgtcgtacggggaccaaacgggaccacggtccaccggtcctaccgtacgccctaccaaccgacggcccagtcccggtccctcccccgtgccctaaccccgtcctaccgaacgacgccaccgtcggtacgggg

SEQ ID NO: 375037 - DNA, 543 bp, Homo sapiens
  misc_feature: GZ8MTXP02FNV4V.51.26.C04.1.454.CMB.2.raw
  modified_base (516)..(516): a, c, t, g, unknown or other
  modified_base (533)..(533): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagattaagttggggtctaagtatgtttcgtggtatcaacatcacccaggcccggtccccgatactcgctcctctatcatgatgccaagccggccctcgagggactcccgtgacgcgtacttctctggcctcaactcgtggggacacgagccactctcgaccagtccgcggacccaggctgtgatgagcgtagacttattactgtacgaggcggttagggacgaggggagccgtgacgtgtttgggcgggaggaccgagtcggtacgccggtcgtacgtccgacgccgaacggcnccggcccctcggtcccnccgtcgtccg

SEQ ID NO: 375038 - DNA, 565 bp, Homo sapiens
  misc_feature: GZ8MTXP02I7SFT.51.26.C04.1.454.CMB.2.raw
  modified_base (260)..(260): a, c, t, g, unknown or other
  modified_base (334)..(334): a, c, t, g, unknown or other
  modified_base (356)..(356): a, c, t, g, unknown or other
  modified_base (385)..(385): a, c, t, g, unknown or other
  modified_base (387)..(387): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggagcgtggtccagcctgggaggtccctcagactctcctgtgcagcctctggcttcaccttcgacaacttttaatatgcactgggtgcgccgggctccaggcaaggggctggagtgggtggctgttataacttcngatggaggtacaacatatactcagacgccgtgagggccgattcacatctcagagacattcggaacacactgtcnctgacaaatgaacagcctaganagctggagacagggctgtttatactgtgngngatccgactcacgtggtacggggtattactcctacgacgtaacgtagtggacgtcgtggggaccaaagggctacgacggtcaccgtctcctacgcctccaccgaacggccctaacgtcccggtccttcccccgtggaacccgtacccttacccaccctaaacgacgaccaccgtccgg

SEQ ID NO: 375039 - DNA, 599 bp, Homo sapiens
  misc_feature: GZ8MTXP02GC7UV.51.26.C04.1.454.CMB.2.raw
  modified_base (223)..(223): a, c, t, g, unknown or other
  modified_base (261)..(261): a, c, t, g, unknown or other
  modified_base (284)..(284): a, c, t, g, unknown or other
  modified_base (341)..(341): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctgganataagtttggggtctaagtatgtttcgtggtatcaacntcacccaggccggtcccgatacngctcctctatcatgatgccaagccggccctcgagggtactcccgtgacgcgacttcnctggctccaactcgtggggacacacgccactctgacccactcccggacggacccagggcctggtggacgtgacgggctcgtaaccttaattaccgttggtaccgaggggtccggtagggggaccgaagggggcggcgttggccggttagtttccggggcgggtacggggactacggtcgtaccgtaccgtccgtacggaccgacggacccgaagggccctccggtccccccgtgggtacccaccgtccgtttccccgg

SEQ ID NO: 375040 - DNA, 618 bp, Homo sapiens
  misc_feature: GZ8MTXP02I9BBX.51.26.C04.1.454.CMB.2.raw
  modified_base (224)..(224): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctgganataatttggggtactaagtattgtttcgtggtatcaacatcacccaggcccggtccccgatacctgctcctctatcatgatgccaagccggccctcgagggactcccgtgacgcgtacttctctcggcctaccaacgtcgtcgggggacacgacgccactctacgaccacgtccgccggacccaggctaggtggacgtggaggctgacttagttactgtcgtaggcggtaggggacgaggggaggtcgtggcggttagtttcgggcggggacgggtaccggtaggttccgtcggtaaacccggttccgttaacgggtccgaaccggtaccccggaacgggtcccgttacccggcccccgttacgggtaccctaccgtttcccggtttcccccgg

SEQ ID NO: 375041 - DNA, 539 bp, Homo sapiens
  misc_feature: GZ8MTXP02GGGDT.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgtttcgtggtatcaacatcacccaggccggtccccgatactgctcctctatcatgatgccaagcggccctcgagggactccctgacgcgacttctctggctccaactcgtgggggacacacgccactctcgaccactccgccggacccaggcctgtggatggagctgactattactgtcgaggcgtggggacgagggaggcgtggcgtagtttcgggcgggtacgggacgtagtcgtcggacccgtcgtacggtcacggacccgaaggcctccgccccgtcgtccacgtcttcccg

SEQ ID NO: 375042 - DNA, 589 bp, Homo sapiens
  misc_feature: GZ8MTXP02FPPVC.51.26.C04.1.454.CMB.2.raw
  modified_base (257)..(257): a, c, t, g, unknown or other
  modified_base (351)..(351): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttatacttntgatggaggtacaacatattactcagacgccgtgaggggccattcacatctccagagacaattccgggaacacactgtctctgacaaatgaacngcctgagagctgagacagggcttgtttatactgtgtgcgatccgacctctacgtgggtacggggacgtttacttcccgtccgacgaaacggtatgggaccgttcgtacgggggaccaaacggggaccacggtccaccgtcctaccttacgccctaccgaccgaacgggcccagtccggttccttcccccgtcggcccaaccccgtccctaccaacggacgaccaccgtcggtcggggg

SEQ ID NO: 375043 - DNA, 585 bp, Homo sapiens
  misc_feature: GZ8MTXP02J04I7.51.26.C04.1.454.CMB.2.raw
  modified_base (200)..(200): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaanatgcactgggtgcgccgggctccaggcaaggggctggagtgggtgctgttatacttctgatggaggtacaacatattactcagacgccgtgaggggccattcaccatctccagagacaattccgggaacacactgtctctgacaaatcgaacagcctgagagctggagacagggctagtttattactgtgtgcgtactccgacctcacgtgggtacgggtacttactccgtcgacgtaacggtgtcgggacgtcgtcgggggaccaagggacccacggtccaccggtctccgtacgccctaccgaccgtaacgggcccacgtccgggtccttcccccgtggcccaaccccttccgaccaaacgccgcctacccgtcgtccggggg

SEQ ID NO: 375044 - DNA, 524 bp, Homo sapiens
  misc_feature: GZ8MTXP02GCSSW.51.26.C04.1.454.CMB.2.raw
  modified_base (260)..(260): a, c, t, g, unknown or other
  modified_base (312)..(312): a, c, t, g, unknown or other
  modified_base (433)..(433): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccacctcagtgtccgtgtccccaggacagacagccacatcacctgctctggagattaagttggggtactaagtatgtttcgtggtatcaanatcaccaggccggtcccgatactgcctctctatcatgatgccaagcgccctnagggatccctgagcgacttctctggctccaactcgtggggacacgagccactctcgaccactccgcggacccaggcctgtggatgagctgacttatactgtcgaggcgtgggagaaggggngcgtgtcgtaggttcgggcggacggacgtagtcgcgtaccgtacgtacgtacgacgaccgaacgccgtccgcccgtcgtcctccgtcgtcg

SEQ ID NO: 375045 - DNA, 581 bp, Homo sapiens
  misc_feature: GZ8MTXP02I1GNJ.51.26.C04.1.454.CMB.2.raw
  modified_base (222)..(222): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcactgctctgganattaagtttgggtactaagtatgttcgtggtatcaatatcacccgaggcccgtccccgatactcgctcctctatcatgatgccaagcgccctcgaggactcccctgacgcgtacttctcgtcggcctccaactcgtcggggacacgacgcccaactctacgaccacgtcccggccggacccaggcctgtaggatggaggctagacttattacgtagtcgaggcggtagggacgaagggtggcgtggacggttacgtttcggggacggtacgggtacgtacggttaccgcggtacccgtacgtacgggtacaccggaccgaacgggtcccgcccgtcccgtcgtacctccttccgtcccg

SEQ ID NO: 375046 - DNA, 666 bp, Homo sapiens
  misc_feature: GZ8MTXP02GPL1M.51.26.C04.1.454.CMB.2.raw
  modified_base (227)..(227): a, c, t, g, unknown or other
  modified_base (384)..(384): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagcccaccctcagtcgtccgtgtccccaggacagacagccaccatccacctgctctgganattaagtttggggtactaagtatgtttcgtggtatcaacatcacccaggcccggtccccgatactcgctcctctatcatgatcgaccaaggccggcccctgacgggactcccgtggacgtcgacttcctcgtggcctccaactcggtcggggacacngtccccatctacgaccctacgtcccggaccgggacccgaggtccgtgtacggtacgttggaacggtcgtacggtacttaacgtttaaccgtcggtacggtaacggggtcgggttacgggggtacggaacgggggacgggtcgtcgggtacggttacggtttacggggaccgggtacggggacccgtaggttccgtcggtacccgttaccggtacggtaccgaccggacccgaacggtcccgtcccggtcccccgtaccggtccctaccgtccgtttcccccg

SEQ ID NO: 375047 - DNA, 638 bp, Homo sapiens
  misc_feature: GZ8MTXP02HSB9Q.51.26.C04.1.454.CMB.2.raw
  modified_base (223)..(223): a, c, t, g, unknown or other
  modified_base (241)..(241): a, c, t, g, unknown or other
  modified_base (281)..(281): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctgganataagtttgggctaagtntgttcgtggtatcacatcacccaggcccgtccccgatacngctcctctatcatgatgaccaagccggccctcgagggactcccctgacgtcgacttctctggccttccaacgtcgtgggggactacacgcccactctcgacccacgtcccggaccggacccaggtcctaggtcggtactggaacgggcttacggtaactaaagtttcctaggttccgagggtccggtaggggaccgacggggaagggcggttacggacgggttacgttttcgggacgggtaacggggaccggtacgtacgtacggtaccggtaccgttacgggtaccaacggcccggaaaacccggtcgtccccggtaccccggtcccggtcctaaccgtttacccgtttcccccgg

SEQ ID NO: 375048 - DNA, 598 bp, Homo sapiens
  misc_feature: GZ8MTXP02JR7XP.51.26.C04.1.454.CMB.2.raw
  modified_base (279)..(279): a, c, t, g, unknown or other
  modified_base (309)..(309): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccgaggcaaggggctggagtgggtgctgttatacttctgatggagtacaacatatacncagacgcgtgagggccatcacatctcaganacaagttccggaacacactgtctctagcaaatcgaacagcctagagagctggacggacgagggtcttgtttaatacgtgtagtgacgacgtcccgacctcgtacgtcggggtaacgggtacgtttaccttcccgtaccgacgtacggttagtcgggacgtcggtacggggaccaacgggaccgacggtacgacccgtctccgttacgccctaccgaccgacggcccacgtccggtccctccccgcgccctccccgtctaccgaacgtccgaccgtaccgtcggacgggg

SEQ ID NO: 375049 - DNA, 576 bp, Homo sapiens
  misc_feature: GZ8MTXP02F11D8.51.26.C04.1.454.CMB.2.raw
  modified_base (439)..(439): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggatattaagttggggtactaagtattgttcgtggtatcaacatcaccaggccgtcccgatactgctctctatcatgatgaccaagccgccctcgagggactcccgtgacgcgtacttctcgtggtcctaccgaacttcgtcggggacacacgcccactctacgaccacgtcccggaccggacccgaggctgtgagtgagctagtacttagtactgtcgngggtcgtagggacgagggaggcgtggtcgtaggtttacgggcgggacggtacgtaggtcgtacggtaccgtacgtacggtaccgacggacccgaacggtccgtccggcccccgtcggtacctccgtcgtttccccgg

SEQ ID NO: 375050 - DNA, 676 bp, Homo sapiens
  misc_feature: GZ8MTXP02G3EPL.51.26.C04.1.454.CMB.2.raw
  modified_base (223)..(223): a, c, t, g, unknown or other
  modified_base (300)..(300): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctgganattaagttggggtactaagtatgtttcggtggtatcaacatccacccgacggcccggtccccgatacctgcctcctntatcatgatcgacaacgccggccctcgaagggtctcccgtgacgtcgtattccgtcgtcggccttaccgaaccgttcggtacgggggaccacgaccgacccacttcgtacacccacgtcccggaccgggacccaggcgtggtggactggaggtctacgtaacttagttaccgtggaccggaggggtccggtacgggggacgaggggcgggtacctgggtccggttaacggtttcgggggaccgggtaaggggtacccgtaacggttcggtaccggtacccgggttaccttaccgggtaccgacccgggacccgaacgggtcccgttaccccggccccccgttacgggtaccctaccggtttaccctttacccccgg

SEQ ID NO: 375051 - DNA, 593 bp, Homo sapiens
  misc_feature: GZ8MTXP02JCO1E.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttatacttctgatggaggtacaacatatactcagacgccgtgaggggccgattcaccatctccagagacaagtccgggaacacactgtctctgacaaatcgaaacagcctagagagctggaggacagggcttgtttaattactgtgtgcgactccgactcacgtgggtacggggtattacctccgtcgacgtaaacggtgtcggacgtcgtcggggaccgaaagggaccgacggtccaccgtcctacctacgccctaccgacccaaacggggccccaagttcccggtcccttcccccgtggccctaaccccgttcccaccgacgccgaccacccgtcggccgggg

SEQ ID NO: 375052 - DNA, 660 bp, Homo sapiens
  misc_feature: GZ8MTXP02JPTEL.51.26.C04.1.454.CMB.2.raw
  modified_base (223)..(223): a, c, t, g, unknown or other
  modified_base (413)..(413): a, c, t, g, unknown or other
  modified_base (619)..(619): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctgganattagttgggtctaagtatgttcgtggtatcacatcacccaggcccggtccccgatactgcctcctctatcatgatgcagtccggccctcgaggactcccgtgacgtcgacttctctcggctccaacgttcgtcggggacacgacgaccctacgtccgtacgacccaacgtcccgggaccggggaacccngggtcgtcggtagggagtacggtaacggcgtaacggtaactttagttaacccgtggtaccgaggggtacgggtacggggacgaagggggtcgtaccggttggtcccggttaaggttttccgggggaccgggtaacgggggtaccctacgggttcgtacgggtacccgtaccggtacggtaccgaccggaccccgaaggggtccccnccgggtacccccgtcgtacccgtacccgtcgtttcccccgg

SEQ ID NO: 375053 - DNA, 585 bp, Homo sapiens
  misc_feature: GZ8MTXP02F97G6.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccgattcaccatctccagagacaattccgggaacacactgtctctgcaaatgaacagcctgagagctgaggacagggtcttgtttatactgtgtgcgatccgacctcacgtgggtacggggtagttaccgttcctccgcgtaaaccggtatcgggtacgtcggtcggggccgaaacgggaccaacggtcgaccgttctaccgttacgccctccaccgaacgggcccagtccggtcctcccccgtggcccaaccctccctaccaacgccgtccaccgtcgtaccgggg

SEQ ID NO: 375054 - DNA, 642 bp, Homo sapiens
  misc_feature: GZ8MTXP02F1RKB.51.26.C04.1.454.CMB.2.raw
  modified_base (177)..(177): a, c, t, g, unknown or other
  modified_base (225)..(225): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtccgtgtccccaggacagacacgccacatccacctgctctgganataagttgggtactaagtatggttcgtggtatcaacatcacccaggcccggtccccgatactgacctcctctatcatgatgccaagccggccctcgagggactcccgtgacgcgacttctctcggctaccaactcgtggggacacgagcccactctcgaccacgtcccggaccgggacccgaaggccgttgtgggactgggacggcgtaggtacttaatttaccgtggttaccgaggggtccgggtacgggggaacgagggggacgggacgtcgggtacgttacggtttcggggacgggtaggggtaacccgtacggttccggtacgggtaacccgttccggttaacgggtccgacggaccccgaagggtcccgtcccggtcccccgttacgggtacctaccgttccgtttccccgg

SEQ ID NO: 375055 - DNA, 610 bp, Homo sapiens
  misc_feature: GZ8MTXP02HDYQF.51.26.C04.1.454.CMB.2.raw
  modified_base (401)..(401): a, c, t, g, unknown or other
  modified_base (419)..(419): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagtataagttggggtactaagtatgtttcgtggtatcaacatcaccacggccgtccccgatactgctcctctatcatgatcgccaagccgccctgacggactccctgacgcacttctcgtacggcctccaactcgtcggggacacacgccactctcgaccacgtcccggccggaacccngggcctggtacggtacgnggaacggtcgtacgacttagttaccgttggtccgtaagggcgggttacggggacgagggggacgcggtcggtcggttaacggtttcggggcggtaacggggtaccctaggtccgtcgtaacccgttccgtacggtccgaccgtacccgaacggtccgtccggcccccgtcggtccaccgttccgttccccg

SEQ ID NO: 375056 - DNA, 749 bp, Homo sapiens
  misc_feature: GZ8MTXP02JREBX.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgttcgtggtatcaacatcaccaggccgtcccgatactgctcctctatcatgatgccaagcgccctcgagggactccccgtgacgcggtacttccgtcgtcggacctccgaaaccgttcgtcgggggaaccaacgacggacccctacttaccgcgggaacccctaacgttccccggaccccgggggaaccccgacggggtcccgttagggttcggggacttagggaaacgggtcccgttagggtaaacccgtttaaactttaacccggttggttaccggaacgggggtcccggggtttagggggtaacccggtaaagggggaacggggtcccgttaggggttccgggttaacgggtttttccgggggacccgggggttaacggggaacccgggtaaggttcccggtaccgggtaaccccggttccggttaacggttcccggacggacccccgaagggtcccgtaacccggtcccccgtacggtccccgtaccgtccctttcccccgg

SEQ ID NO: 375057 - DNA, 657 bp, Homo sapiens
  misc_feature: GZ8MTXP02H7TVI.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaactttaatatgcacgtgggtgcgccgggctccgaggcgaaggggctggagtgggtgctgttataacttctgatggaggtacaacatatactcagacgccgtggagggccgattccacatcctcagacgacaacgttccgggaacacactgtctctgacaaatcgaacagcctgagagctggagggaacaggggtcttagtttactacgtgtgtgcgtactcccgtacctcgtacgtcgggtacggggtacgttaccgttccgtacgacgtaaacggttagtcgggtacgtcggtacgggggaccgtaacggggacccgtacggtccgaccgttcctacgttacgacccttaccgacccggaaaccgggccctaacgtcccggttcccttcccccgttcggacccctaaccccgtttacccgaacccgaaaacggcgaccccgtaccggttaccgggtccggggg

SEQ ID NO: 375058 - DNA, 619 bp, Homo sapiens
  misc_feature: GZ8MTXP02J3IUB.51.26.C04.1.454.CMB.2.raw
  modified_base (212)..(212): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtncgccgggctccaggcaaggggctggagtgggtggctgtataacttctgatggagtacaacatatactcagacgccgtgagggccgatcaccatctccagagacaagttccggaacacactgtctctgacaaatcgaacagcctagacgagctggagaacgagggcttagtttattacgtgtagtgcgtactccgacctctacggtacggttacggggtacgtttaccgttcccgcgtacgtaaacgggtgtacgggacgtcgtcgggggacccgaaacgggcccgtacggtccgtaaccggtcctaccgttacgaccctcccaaccgaacgggcccctacgtccgggtccctcccccgttggcccctaacccgttccacccgaacgaccgccgaccgtcgtacgggg

SEQ ID NO: 375059 - DNA, 569 bp, Homo sapiens
  misc_feature: GZ8MTXP02IQZRV.51.26.C04.1.454.CMB.2.raw
  modified_base (266)..(266): a, c, t, g, unknown or other
  modified_base (491)..(491): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtcccgtgtccccaggacagacagccaccatccacctgctcgtggagattaagtttggggtctaagtattgtttcgtggtatcaanatcacccaggcccggtccccgatactgctcctctatcatgatgccaacgcggccctcgagggactccctgagcgattctctggctccaacttcgtcgggggactacgacgcccactctcgaccacgtccgaccggcccgagggcctggtcggagtagggaggtcgtagtactattaacgtgtcgtagggcgtggggaacgaggggcgcgtggcgtagtttcgggnggtacggaccgagtcgtcgaccgtacgtcgtcgacgacccgaacggccgtcgtccccgtacgtcctacgtctttcccg

SEQ ID NO: 375060 - DNA, 604 bp, Homo sapiens
  misc_feature: GZ8MTXP02JO7Z8.51.26.C04.1.454.CMB.2.raw
  modified_base (319)..(319): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtggctgttataacttctgatggaggtacaacatattactcagacgccgtgaggggccgattcaccatctccaganacaattccgggaacacactgtctctgcaaatcgaacagcctgagagctggagacgagggtctgtttatactgtgtgcgatccgactcacgtgggtacgggtagttacttccgtcgacaacggttatcggtacgtcgtcggggaccaacgggaccacggtccaccgttcctaccgttacgcccttaccaaccgtaacggggcccctaaacgtccggttcccttcccccgtcggtcccctaaccccgtccctaccgaacgacgacctacccgtttcggtaccggggg

SEQ ID NO: 375061 - DNA, 621 bp, Homo sapiens
  misc_feature: GZ8MTXP02G79DA.51.26.C04.1.454.CMB.2.raw
  modified_base (201)..(201): a, c, t, g, unknown or other
  modified_base (262)..(262): a, c, t, g, unknown or other
  modified_base (283)..(283): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaactttaanatgcacgtgggtgcgccgggctccgaggcaaggggctggagtgggtgcttgttataacttngatggagtacaacatattacnagacgcgtgagggcatcacatctcagagacaagttcggaacacactgtctctgacaaatacgaacagcctgagagctggagtacgagggtcttagtttattacgtggtacgtgacgtactaccggacctcgtacgtcggggtaacggggtacgtttaccgttacccgtccgtaacgtaacggtacgttcgggacgtcggtacgggggaaccaacggggaccacgggtactaccgttcctaccgttaccgccctaccgaaccgaaccgggcctacggtcccgtcccttccccgtcggcctaacccccttcgaaccaacgccaccgtaccgtcggccggg

SEQ ID NO: 375062 - DNA, 589 bp, Homo sapiens
  misc_feature: GZ8MTXP02JUV8Z.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaactttaatatgcactgggtgcgccgggctccaggcaaggggctggagtgggtggcttgttataacttctgatggagtacaacatatactcagacgccgtgagggccgattcaccatctccagagacaagttccggaacacactgtctctgacaaatcgaacagcctagagagctggaggacgagggcttgtttatactgtgtgcgactccgactcgacgtgggtacgggtacttaccttcccgtcgacgtaacggtagtcggtaccgtcgtcggggaccaacgggaccacggtacaccgttctccgtacgccctaccgaccgacgggccctacgttccggtccttcccccgagccctaacccgtcctaccgacgtacgacctaccgtcggacgggg

SEQ ID NO: 375063 - DNA, 570 bp, Homo sapiens
  misc_feature: GZ8MTXP02IYSI7.51.26.C04.1.454.CMB.2.raw
  modified_base (225)..(225): a, c, t, g, unknown or other
  modified_base (293)..(293): a, c, t, g, unknown or other
  modified_base (413)..(413): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatccacctgctctgganattaagtttggggtctaagtattgtttcgtggtatcaacatcaccaggccgtcccgatactgctcctntactcatgatcgaccaagccggccctcgagggactcccgtgacgcgtattctctggcctccaactcgtgggggacacacgcccactcgtcgaccacgtcccggcggacccgaggcctggnggagtgaggtctagacttattactgtacgaggcggtgggacgaggggacggcgtcggacgtgtttacgggcgggacgggacctacgtcgtcggtaccgtccgtacggtcacgacccgaaggtccaccggtccccgtcggtcctacgtcctttacccg

SEQ ID NO: 375064 - DNA, 567 bp, Homo sapiens
  misc_feature: GZ8MTXP02HIXTW.51.26.C04.1.454.CMB.2.raw
  modified_base (307)..(307): a, c, t, g, unknown or other
  modified_base (310)..(310): a, c, t, g, unknown or other
  modified_base (326)..(326): a, c, t, g, unknown or other
  modified_base (429)..(429): a, c, t, g, unknown or other
  modified_base (437)..(437): a, c, t, g, unknown or other
  modified_base (529)..(529): a, c, t, g, unknown or other
  modified_base (554)..(554): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtgctgttataacttctgatggaggtacaacatatactcagacgccgtgagggccatcacatcncanagacaatccggaacanactgtctctgacaaatcgaaacagcctagagagctgaggacagggtcttgtttatacgtgtgtgcgatccgacctcacgtggtacgggtattactcctccganaaacggtntggacgtcgtggggacccaagggacccacgggccaccggtcctcccgtaacgccctaccgaccgaaacggcccaagtccggtccttcccccnggccctaacccgcctacaacgaccnccaccgtcggcgg

SEQ ID NO: 375065 - DNA, 567 bp, Homo sapiens
  misc_feature: GZ8MTXP02I3N4F.51.26.C04.1.454.CMB.2.raw
  modified_base (225)..(225): a, c, t, g, unknown or other
  modified_base (420)..(420): a, c, t, g, unknown or other
  modified_base (501)..(501): a, c, t, g, unknown or other
  modified_base (557)..(557): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcaggtgtccgtgtccccaggacagacagccaccatcacctgctctgganataagtttggggactaagtatgtttcgtggtatcaacatcaccaggcccggtccccgatactgctcctctatcatgatcgccaagcggccctcgagggactcccctgacgcgtacttcctcgtcggcctaccaacgttcgtcgggggacacgacgccactctcgacccagtcccgcggacccaggccgtgtcggntggaggtctaggacttattaccgtgtacgagggtcggtgggacgtggggaggtcgtgcgtagtttcgggcgggaggaccgngtcgtcggaccgtacgtacggtacacgaccgtaacggctccggtcccctcggtccnctcgttcccg

SEQ ID NO: 375066 - DNA, 564 bp, Homo sapiens
  misc_feature: GZ8MTXP02I9Y4D.51.26.C04.1.454.CMB.2.raw
  modified_base (315)..(315): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtgctgttataacttctgatggaggtacaacatattactcagacgccgtgaggggccatcacatctccaganacaattccgggaaacacactgtctctgacaaatcgaaacagcctgagagctggagacagggctgtttatactgtgtgcgatccgacctcacgtgggtacgggtattacctaccgtcgactaacggtatcggacgtcgtacggggccaaagggccgacggtcaccgtctacctcgccctccaccgacggcccagtccggtcctcccccgtagccctaacccgtccaccgacgacgccaccgtcgtacggg

SEQ ID NO: 375067 - DNA, 580 bp, Homo sapiens
  misc_feature: GZ8MTXP02I18N3.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtggctgttataacttctgatggaggtacaacatattactcagacgccgtgaggggccgattcacatctccagagacaattccgggaacacactgtctctgacaatgaacagcctgagagctgaggacagggtctgtttattactgtgtgcgtactccgacctcgacgtgggtacggggtagttacttccgtccgacaacggtatggacgtcgtcggggaccgaacgggaccacggtcaccgtctcctacgcctccaccgacggcccagtccggtcccttcccccgtcggccctaacccgtccctacccaacgtacgaccaccgtcggtaccggggg

SEQ ID NO: 375068 - DNA, 686 bp, Homo sapiens
  misc_feature: GZ8MTXP02GFJXD.51.26.C04.1.454.CMB.2.raw
tcagcgatcgtatacacgaccggtgctcgatttagtctagcgactttgggttgggctgggcctcaggaagcagcatcggaggtgcctcagccatggcatggatccctctcttcctcggcgtccttgcttactgcacaggatccctggccgcctatgacctgactcagccaccctcagtgtccgtcgtccccaggacagacagccacatcacctgctctggagtattaagtttggggtactaaggttattgtttcgtggtatcaacatcaccaggccggtccccgatactcgcctcctctatcatgatgaccaagccggccctcgacggggtactccgtggacgcgtacttctctggcctccaactcgtcggggacacgagcctaactcgtacacccacgtcccgggaccgggacccagggtcctgggttacggacgttggaacggggtcttcgggaacttacgttaacgttggttcgaaggggtccggtagggggacgacgggggacggcggtaggtcggttaggttttccgggggaccggggtacgggggtaacccgtacgggttccggttaccggtaacccggggttccctttacggggaccgtaccggggtaacccccgaaacgggtccccgtcccggtaccccccggttggggtaccctacccggttccgttttccccccgg

SEQ ID NO: 375069 - DNA, 645 bp, Homo sapiens
  misc_feature: GZ8MTXP02IISCC.51.26.C04.1.454.CMB.2.raw
  modified_base (361)..(361): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccggctccaggcaaggggctggagtgggtgctgttataacttctgatggaggtacaaacatattactcagacgccgtgaggggccatcacatctccagagacaattccgggaacacactgtctctgacaaatcgaacagcctgagngctggaggacagggtcttgtttatactggtgtgcgtactccgacctcgacgtaggggtacggggtacgtttaccgttccgaccgacgtaaacggttagtcgggtacgtcggtacgggggaccctaaacgggaccgacggtccaccggttaccttacccgttacgacccctaccgaaccgtaaccgggtccctaaccgttccggttcccccttaccccgtccggaccctaacccccgtacctacccgaaacggtaccgacccgtaacccgtcgggtacccggggg

SEQ ID NO: 375070 - DNA, 595 bp, Homo sapiens
  misc_feature: GZ8MTXP02F8TL7.51.26.C04.1.454.CMB.2.raw
  modified_base (451)..(451): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctgggagtgggtggctgttataacttctgatggaggtacaacatattactcagacgccgtgacgggcattcaccatctccagagacaagttccgggaacacactgtctctgacaaatcgaacagcctgagagctggaggacgaggggtcttagtttatacgtgtgtagcgatcccgactcgacgtgggtacgggtattactcctcgacgtaaacggtntacggtacgtcggtcgggaccgaagggccacggtcctacgtctccttacgccctaccgacacgggccctacgtccggttcccttccccgtcgtccccgtaacccctcccgtacccgaaacgccgaccacccgtcggtaccgggg

SEQ ID NO: 375071 - DNA, 598 bp, Homo sapiens
  misc_feature: GZ8MTXP02HBREY.51.26.C04.1.454.CMB.2.raw
  modified_base (295)..(295): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggatattaagtttggggtactaagtatggtttcgtggtatcaacatcaccaggcccggtcccgatactgctcctntatcatgatgaccaagccggccctgagggactcccgtgacgcgacttctctggcctaccaactcgtcggggacacacgccactctacacccactcccggccgggacccagggcctgggtaggactggacgtctacggtaacttacttacgtgttaccgagggtccggtagggggacgagggggacgcgtcggcggttacggtttcgggcgggtacgggacgtacggtcgtacggtaccgtaccgtacggtaccgacgacccgaacggccgtccggcccccgtggtccctacgtccgttccccg

SEQ ID NO: 375072 - DNA, 591 bp, Homo sapiens
  misc_feature: GZ8MTXP02FXVP1.51.26.C04.1.454.CMB.2.raw
  modified_base (257)..(257): a, c, t, g, unknown or other
  modified_base (270)..(270): a, c, t, g, unknown or other
  modified_base (278)..(278): a, c, t, g, unknown or other
  modified_base (352)..(352): a, c, t, g, unknown or other
  modified_base (560)..(560): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaacttttaatatgcactgggtgcgccgggctccaggcaaggggctggagtgggtgctgtatactngatggagtacaanatattacnagacgccgtggagggccattcaccatcctcagacgacaagttccggaacacactgtctctgacaaatcgaaacngcctagaagagcgtgggaaggacgaggggtctttagttttaacttacgtggttagtgacgtacttcccgacctcgtacgtcggggtacggggtactttaccgttcccgaccgtacgtaaacggtagtcggtacgtcggtacggggacctaacgggccacggtccaccgtctacctacgcctaccacgacggccagtccgtcctcccgngcccaaccgtccacacgcgcacctcggcggg

SEQ ID NO: 375073 - DNA, 631 bp, Homo sapiens
  misc_feature: GZ8MTXP02JDXYB.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagattaagttggggtctaagtatgttcgtggtatcaacatcacccaggccgtccccgatactgctcctctatcatgatgccaaggccggcccctcgacgggactcccgtgacgcgtactttcctcgtcggtcctaccaacgttcgtcgggggaccacgacggcccactctacgacccacgtcccgccgggacccaggcctggtcgagtaggacggtctaggtaacttacgtttacgtacggttcgaaggggtccggtacgggggaccgaagggggacggtccggtgggtcggttaggttttcggggacggggacggggtaccgtaggtccgtacgggtaccgtccggtacggtccgacggtacccgcgggtccgtccggccccgtcggtccgtaccgtcgttcccccgg

SEQ ID NO: 375074 - DNA, 598 bp, Homo sapiens
  misc_feature: GZ8MTXP02IIR2L.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtggctgttataacttctgatggaggtacaacatattactcagacgccgtgaggggccattcaccatctccagagactaagttccgggaacacactgtctctgacaaatcgaacagcctagagagctggaggacgagggtcttagtttatactggtgtgcgatccgacctcacgtgggtacgggtagttaccttccgtccgacgtaacggtatcggtacgtcgtcggggaccaagggaccacggtccgaccgttctaccgtacgccctaccaccgacgggccctacgtccgttccctcccccgtggccctaaccccgtcctacccgaacgacgccgtacccgtcggtaccggggg

SEQ ID NO: 375075 - DNA, 662 bp, Homo sapiens
  misc_feature: GZ8MTXP02I2YYH.51.26.C04.1.454.CMB.2.raw
  modified_base (222)..(222): a, c, t, g, unknown or other
  modified_base (278)..(278): a, c, t, g, unknown or other
  modified_base (285)..(285): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccacctcagtgtccgtgtccccaggacagacagccacatcacctgctctgganatagttgggtactaagtatgttcgtggtatcaacatcaccaggccgtcccgatacngctcctntatcatgatcgactaagcgccctagaggactccgtgagcgtacttctcgtcggcctaccgaacgttcgtcgggggacacgacgaccctactcgtacgaccctaacgcccggaccggacccgtaggctacggtagacgtaggacgggtctacggtacttaacgttacgttacggtaccggtagggtaccggttacgggggaaccgaacgggggtaggtccggttaggtacgggttacggttttaccgggggaccggggtaacgggtaaccgtacgggttccgtaccgggtaaaccgttccggtaacggttaccgacgttacccggaacggtcccgtaccggtcccccgtagggtaccctacgggtacctttccccggg

SEQ ID NO: 375076 - DNA, 666 bp, Homo sapiens
  misc_feature: GZ8MTXP02HR9W7.51.26.C04.1.454.CMB.2.raw
  modified_base (266)..(266): a, c, t, g, unknown or other
  modified_base (274)..(274): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacacgccaccatccacctgctctggagtataagtttggggtactaagtattggtttcgtggtatcanactcaccncggccggtcccgatactgctcctctatcatgatgaccaacggccgcccctacgacgggactcccgtagacgtacgtaccttcgtctcgggcctcctaaccgtcgtcgggggacacgacgccctaacgtctacgaccacgtacccgacccgggacccgcggcgttcggtggagtggacgggtactacggtaacttaagtttaaccgtgttaccggtagggtaccgggttaggggaaccggtagggggacggtcggtaggtacgggttaacgttttcgggggacggggtacgggtaccgtacggtacgtacggtaccggtaccgttacggccgtaccgaccggaacggtccgtacccggccccgttaccgtccgtaccgttcccgtttccccgg

SEQ ID NO: 375077 - DNA, 706 bp, Homo sapiens
  misc_feature: GZ8MTXP02HIZ2A.51.26.C04.1.454.CMB.2.raw
  modified_base (260)..(260): a, c, t, g, unknown or other
  modified_base (315)..(315): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggagtccctcagactctcctgtgcagcctctggcttcaccttcgactaactttaatatgcacgtgggtgcgccgggctccgaggcaaggggctggagtgggtgctgttataattcngatggagtacaacatatactcagacgccgtgagggccgatcaccatctaccaganacaacgttaccggaacacactgtctctgactaaatcaacagcctgagagtctggaggacagggtcttagttattacgtgtgtgcgtactaccggtacctcgtacgttcgggggtaacgggtacgtttaccgttcccgtccgtaacgtaacggttaaggcgggttaaccggttcggtacgggggacccgaaacggggtacccgtaccgggtaccgtacccggttccgttacccgtttaacggcccccttacccgaaacccggaaaccggggtccccctaacggttcccgggtttacccccttccccccggtcggtaacccccttaacccccgttacccgtacccgtaaaacggaccgtccccgtaaacccggtttaccggggtacccggggg

SEQ ID NO: 375078 - DNA, 596 bp, Homo sapiens
  misc_feature: GZ8MTXP02IT817.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaacttttaatatgcacgtgggtgcgccgggctccaggcaaggggctggagtgggtggctgttatacttctgatggaggtacaacatatactcagacgccgtgaggggccgattcaccatctccagagacaattccgggaacacactgtctctgcaaatcgaacacgcctgagagctggacggacgagggtcttgtttattacgtgtcgtgcgactccgacctcgacgtcggggtaacggggtacgtttaacttcccgtccggaccaacgggttagtcgggtacgtcgtcgggggaccaacggggaccacgggtcaccgtctccgtacgcctccaccgacggacccagtccggtcctaccccgtcggccctaacccgtccctacacgacgccacctcggtcgggg

SEQ ID NO: 375079 - DNA, 604 bp, Homo sapiens
  misc_feature: GZ8MTXP02HV4IP.51.26.C04.1.454.CMB.2.raw
  modified_base (269)..(269): a, c, t, g, unknown or other
  modified_base (441)..(441): a, c, t, g, unknown or other
  modified_base (462)..(462): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggctttcacctttcgactaaacttttaaatatgcacgtgggtgcgccgggctccaggcaagggggctgggagtggggtgctgttaataacttntgatggaggtacaacatatactcagacgccgtgaggggccgattcacatctccagagacaattaccgggaacacactgtctctgacaaaatcgaaacacgacctgaagagcgtggaggacgagggtcttagtttaatacttgtgtgcgatcccgactcacgtggtacgggtnttacctcctcgacaacggtgnggtacgtcgtcgggaccgaacgggccacggtcacccgtctccgttacgccctaccgaaccgacgggccctacgtccggtacccttcccccgtacgcccaacccgttcccaaccgaacggtacgccctaccgtcggtccgggg

SEQ ID NO: 375080 - DNA, 550 bp, Homo sapiens
  misc_feature: GZ8MTXP02FO3T3.51.26.C04.1.454.CMB.2.raw
  modified_base (326)..(326): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagcccaccctcagtgtccgtgtccccaggacagacagccaccatcacctgctctggagataatttggggtctaagtatgtttcgtggtatcaacatcaccaggccggtccccgatactgctcctctatcatgatgccaagcggccctcagggactcccngagcgacttctctggctccaactcgtggggacacgagccactctcgacatccgccggaccaggctgtgatgagctgacgtattactgtcgaggcggtagggacgaggggacggcgtacggcggtacgtttcgggcgggaacgggaccgagtcgcggtacccgtcgtacggtccgaacggcccgaaaggcccgtcggccccctaggtcccaccgtcctttccccg

SEQ ID NO: 375081 - DNA, 627 bp, Homo sapiens
  misc_feature: GZ8MTXP02GY2EL.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatattactcagacgccgtgaggggccattcaccatctccagagacaattccgggaacacactgtcctctgacaaatcgaacagcctgagagctggagacagggcttgtttatactgtgtgcgactccgactcgacgtggggtacggggtatttaccgttccgtaccgacgtaacggtatcgggtaacgttcggtacgggggaccgaaacggggacccacgggtaccaacccggttccttacccgttacgccctacccgaaccggaaccgggcccctacgttcccggttccccttcccccgtcggacccctaaccctcccgtaccgaaacgcgacctaccgtcggtaccggggg

SEQ ID NO: 375082 - DNA, 647 bp, Homo sapiens
  misc_feature: GZ8MTXP02JCATW.51.26.C04.1.454.CMB.2.raw
  modified_base (271)..(271): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagtattaagtttgggtactaagtattggtttcgtggtatcaacatcaccnggccgtcccgatactgctctctatcatgatgccaagccggccctacgaggactcccgtgagtcgactttctctcggctccaacgtcgtgggggacacgacgccactcgtcgaccactcccggccgggacccagggtcctggttcggagtggacggtcgtacgacgttaacgttaccgtcgtacggagggtccgggtaggggaaccgaggggacgggtcgtgggtacggttacggttttcggggcggggaacggggtacccgtacggttaccggtacgggtaacccggttaccgtacggggttacccgacgtaccccggaacgggtccgtacccgtcccccggttccggtacccgtacccgttaccgtttcccccgg

SEQ ID NO: 375083 - DNA, 611 bp, Homo sapiens
  misc_feature: GZ8MTXP02GKW0J.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgtttcgtggtatcaacatcacccaggcccggtccccgatacctgctcctctatcatgatgccaagccgccctcgagggactccctgacgcgtacttctcgtggtcctccgaacttcgtcgggggaccacacgacccacctcgtacgacccacgtcccggccggacccgaggcctggtggacgtggacggtctaggtacttagttactaggtcgtagggtcggtaggggacgagggggacggcgtggacggttggtttccggggcgggtacgggaccgtaggtcgtacggtaccggtccgtacgggtaccgacggacccgaaggtcccgtaccggtcccccgtcggtaccctaccgtccggtttccccg

SEQ ID NO: 375084 - DNA, 718 bp, Homo sapiens
  misc_feature: GZ8MTXP02JR5U3.51.26.C04.1.454.CMB.2.raw
  modified_base (322)..(322): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgaactaactttaatatgcacgtgggtgccggccgggcctccgaggcgaaggggctgggaggttggggtggtcttagttataacttcgtgagtggagtacaacatattactcagacgcgtggacgggcatccacntctccagagacaagtccggaacacactgtctctagacaatcgaacacgcctagacgagctagggacggacgagggtcttagtttaacgttcgtggtagtcgacgtacgtacccgaaccgttccgtacggtttacgggggtaacggggtttactttaacccgttcccgtaccgtaaccggtaaacggttacgacggggttacggtcgggttaccgggggaacccggtaaacggggacccgtaccgggtacccgtacccgttccgttacccgttaccgcccctacccgaacccggtaaaccggggtcccctacggtccccggttcccttacccccgtcgacccctaacccgttaccccgtaacgaacggtaccgacccgttaccgacgggtcccgggg

SEQ ID NO: 375085 - DNA, 597 bp, Homo sapiens
  misc_feature: GZ8MTXP02F0P2N.51.26.C04.1.454.CMB.2.raw
  modified_base (489)..(489): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagtattaagttggggtactaagtattgtttcgtggtatcaacatcaccaggccggtcccgatactgctcctctatcatgatcgccaaggccgccctcgagggactcccgtgacgcgtacttctcgtggtcctaccaacgttcgtcggggacacgacgcccacgtctcgaccacgtcccgggacccggacccgacggtcgtggtacggagttcggacggtctacgtacttaagttacgtggtacgagggcggtacggggacgaggggnggtcgtggtacgtaggtttcggggcgggtacggaccgtaggtcgtcggaccgtcgtacgtcgaccgacgaacggtcctccgtccccgtcggtcctcgtcgtttccccg

SEQ ID NO: 375086 - DNA, 682 bp, Homo sapiens
  misc_feature: GZ8MTXP02G7CGO.51.26.C04.1.454.CMB.2.raw
  modified_base (263)..(263): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcacctttcgactaacttttaatatgcacgtgggtgcgccgggctccgaggcaaggggctggagtgggtgctgttataacttntgatggaggtacaacatattactcagacgcgtgaggggccgattcaccatctccagagacaattccgggaacacactgtctctgacaaatcgaaactagcctaggagagctggaaggacgagggtcttgtttatttacgtgtgtgcgactccgaacctcgacgttggggtacgggttacgtttaccgttcccgtccgtacgtaaacggttagtcgggtaccgtcggtcgggggacccgaaacggggacccgacgggttccaacccggttccttacccgttacgccccgttaccgaaacccggaacggggtcccctaaacggttcccgggttccccctttcccccgttcgggacccctaacccccgttaccccttaacccgaacggtaaccgcccgtaacccgtttccgggtcccggggg

SEQ ID NO: 375087 - DNA, 636 bp, Homo sapiens
  misc_feature: GZ8MTXP02HT3X5.51.26.C04.1.454.CMB.2.raw
  modified_base (473)..(473): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggatataagtttggggtacttaagtatggtttcgtggtatcaacatcacccaggcccggtaccccgatactcgctcctctatcatgatcgaccaagccggccctcgagggactcccctaggacgacggtacttctccgtcggccttaccaaccgtcgtcgggggaccacgacgcccctactctacgacccacgtcccggaccgggacccagggcctggttgacgtggagtctagtacttaagttctggtacgnggcggtagggaccggaggggacggcgtagggtcgtacggttttcggggacgggacgggtaccgacggttcgtaccgtccggtacccgtacgggtaccgaccggacccgtaacgggtccctcccggcccccgttccggtccctaaccggtttctttccccccgg

SEQ ID NO: 375088 - DNA, 637 bp, Homo sapiens
  misc_feature: GZ8MTXP02GL6A9.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcacgtgggtgcggccgggctccaggcaaggggctgggagtgggtggctgttataacttctgatggaggtacaacatattactcagacgccgtgagggcgattcaccatctccagagaacaattccgggaacacactgtctctgacaaatcgaacagcctgagagctggaggacgaggggctttagtttaattactgttgtgcgacgtacccgcctcacgtgggtaacggggtactttacgttcccgtccgacgtaaaccggttagtcggtacgtcgtaccgggggaccgaaacggggtaccgaccggtcctacccgttccgttacccgttacgccccttaccgacccgaaacggggtcccctaaggtcccggttcccttcccccgtggccctaaccccgtccctaccgaacgcgacctaccgtcgtccggggg

SEQ ID NO: 375089 - DNA, 653 bp, Homo sapiens
  misc_feature: GZ8MTXP02GS8QQ.51.26.C04.1.454.CMB.2.raw
  modified_base (200)..(200): a, c, t, g, unknown or other
  modified_base (212)..(212): a, c, t, g, unknown or other
  modified_base (258)..(258): a, c, t, g, unknown or other
  modified_base (272)..(272): a, c, t, g, unknown or other
  modified_base (298)..(298): a, c, t, g, unknown or other
  modified_base (301)..(301): a, c, t, g, unknown or other
  modified_base (304)..(304): a, c, t, g, unknown or other
  modified_base (306)..(306): a, c, t, g, unknown or other
  modified_base (317)..(317): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggagcgtggtccagcctgggaggtccctcagactctcctgtgcagcctctggcttcaccttcgacaacttttaanatgcactgggtncgccgggctccgaggcaaggggctggagtgggtgctgttatacttngatggagtacaacntatctcagacgcgtgagggcatcacntcncananacatccggaancactgtctctgactaaatcgaaacacgcctaggacgtagcgtaggagacgacgggtcttagtttactacgttgtcgtcgacgacgtaccggtacctacgtacgttacggggtaccggggtacgtttaaccgttcccgtaccgacgtaaacggttagtcgggtaacgttcgggtacgggggaccgaaacgggaccgtacgggtaccaccggtttacctaccgttacgcccctaccgtaaccggaaccggtcccgtaaccttccggtacccttcccccgtacggaccccaacccttacccgtaccaaacgccgaccgtaacccgttcggtacccgggg

SEQ ID NO: 375090 - DNA, 565 bp, Homo sapiens
  misc_feature: GZ8MTXP02F32BR.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattgggtctaagtatgtttcgtggtatcaacatcacccaggccggtccccgatactgctcctctatcatgatgccaagcggccctcagggactcccgtgagcgacttctctggctccaactctggggacacagccactctgacccatcccgcggacccaggcctgtggactggacggtctggacttattaacgtgtcgagggcgtggggacgaggggaggcgtggtacgtagttttcgggacgggaggggtaccctaggtcctcggacccggttccgtacggttccgacggacccgaaaggcccgtcgcccccgtggtacctaccgtcgtttcccccg

SEQ ID NO: 375091 - DNA, 595 bp, Homo sapiens
  misc_feature: GZ8MTXP02FYZHI.51.26.C04.1.454.CMB.2.raw
  modified_base (279)..(279): a, c, t, g, unknown or other
  modified_base (313)..(313): a, c, t, g, unknown or other
  modified_base (407)..(407): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttataacttctgatggagtacacatattacncagacgccgtgacgggccatcaccatctccaganacaagtccggaacacactgtctctgacaaatcgaacagcctgagagctggaaggacgagggtcttgtttaatcgtgtgtgcgtactccgacctnacgtggggtaacgggtacttactccgcgactacggtagtcgggacgtcggtacggggaccaacgggacccgtacggtacctacccgtctaccgtacgccctaccgaccgaacgggtcccacgttccggtcccttcccccgaggcccctaacccgtcccaacgaacgccgtaccaccgttcggcccggg

SEQ ID NO: 375092 - DNA, 547 bp, Homo sapiens
  misc_feature: GZ8MTXP02I71JT.51.26.C04.1.454.CMB.2.raw
  modified_base (213)..(213): a, c, t, g, unknown or other
  modified_base (259)..(259): a, c, t, g, unknown or other
  modified_base (305)..(305): a, c, t, g, unknown or other
  modified_base (312)..(312): a, c, t, g, unknown or other
  modified_base (512)..(512): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtncgccgggctccgaggcaaggggctggagtgggtgctgttatacttngatggagtacaacatatactcagacgccgtgaggggccgatcacanctcaganacatcggaacacactgctctgacaaatgaaacagcctgagacgctggagacagggcttgtttaatactgtagtgcgactccgactcgactgggtacgggtacttactcctccgacgaacggtatggacgtcgtaggggaccaaggaccacggtcacgtctctacgcctccacaacgggccactccggtccttacccccgngccctaaccctccacacgacgcacccgtgaccggg

SEQ ID NO: 375093 - DNA, 700 bp, Homo sapiens
  misc_feature: GZ8MTXP02I8Q29.51.26.C04.1.454.CMB.2.raw
  modified_base (178)..(178): a, c, t, g, unknown or other
  modified_base (247)..(247): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggactccctggccgcctatgacctgactcagccaccctnagtcgtccgtgtcccaggacagacagccacatcacctgctctggatattaagtttggggactaaggttnttggtttcgtggtatacaacactccacccgacggcccggtaccccgatacctcgcctcctctactctatgatcgacctaacggccggtccctcgacgggtctccgtgacgtcgtactttccgtcgtcggacctaccgtaacgttccggtcgggggaaccacgaccgacctacgttcctacgaacccacgtcccggacccgggacccgagggtccgttagggtaggtagtacggacggttacgtacggtaactttaacgtcgttacggtacggtacggggtacgggttacgggggaacggagggggtacggtcggtacgggtacggttacgggttacgggacgggacgggtaacgtcggtacggtacggtaccgtaccggtacggtacccgacggacccgaacggtcccgtacccggtcccccgtcggtacccttacccgtcggtttccccccg

SEQ ID NO: 375094 - DNA, 633 bp, Homo sapiens
  misc_feature: GZ8MTXP02JAJHV.51.26.C04.1.454.CMB.2.raw
  modified_base (201)..(201): a, c, t, g, unknown or other
  modified_base (259)..(259): a, c, t, g, unknown or other
  modified_base (351)..(351): a, c, t, g, unknown or other
  modified_base (371)..(371): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaanatgcacgtgggtgcgccgggctccaggcaaggggctggagtgggtgctgttatacttngatggagtacacatatactcagacgccgtgaggggccattcacatctccagagacaagttccgggaacacactgtctctgacaaatcgaacncgctagagagctggagacgngggtctgtttatacgtgtagtgacgtacgtcccgaacctcgacgttacgggggtacggggtacgtttaccttcccgtcgtacgtaaacggtgtacgggtacgtcggtacgggggaccaaacggggacccgtacgggtcccgaaccgttccgtaccgtaacggcccctaccgaccggtaaacggggcccctaagttcccggttcccttccccggtcggaccctaaccccgtcctaccgaacgacgtccaccgttcggccgggg

SEQ ID NO: 375095 - DNA, 624 bp, Homo sapiens
  misc_feature: GZ8MTXP02HYOEP.51.26.C04.1.454.CMB.2.raw
  modified_base (263)..(263): a, c, t, g, unknown or other
  modified_base (497)..(497): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggagtccctcagactctcctgtgcagcctctggcttcaccttcgactaaacttttaatatgcacgtgggtgcgccgggctccgaggcgaaggggctggaggtgggtgctgttatacttngatggaggtacaacatattactcagacgccgtgagggcgatcacatctcagagacagtaccgggaacacactgtctctgactaaatcgaaacagcctagagacgcgtggaaggacgaggtcttagtttatacgtgtgtcgcgtactccgactcgacgtaggtacgggtacttaccttccgtcgacgtaacggtagtcggtacgtcggtacgggaccgaacgggaccacggtacnccgtactaccgtacgcccttaccgaaccgtacgggccctacggtcccgttcccgttcccccgtcggtacccctaaccccgtaccttacccgaacggtaccgtacccgtaccgtttcgggcccggggg

SEQ ID NO: 375096 - DNA, 623 bp, Homo sapiens
  misc_feature: GZ8MTXP02JO5VJ.51.26.C04.1.454.CMB.2.raw
  modified_base (201)..(201): a, c, t, g, unknown or other
  modified_base (213)..(213): a, c, t, g, unknown or other
  modified_base (260)..(260): a, c, t, g, unknown or other
  modified_base (281)..(281): a, c, t, g, unknown or other
  modified_base (326)..(326): a, c, t, g, unknown or other
  modified_base (360)..(360): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaanatgcactgggtncggccgggctccaggcaaggggctgggagtgggtgctgttatacttntgatggagtacacatatactnagacgcgtgacggggcatcacatctccagagacagtccggaaacncactgtctctgacaaatcgaacagctagagagcnggagacgagggtcttagtttatacgtgtagtcgacgtactccgtacctcgtacggtggggtaacgggtacgtttacctccgtacgacgtaacggtatcgggacgtcggtcggggaaccgaacgggacccgacggtccgtaccgtcctaccgtcgccctaccaaccggacggtaccccacggttcccgttccccgtcccccgtcggaccccctaaccccgttaccgaaccgaacgccgtcccgtaacccgttcgggacccgggg

SEQ ID NO: 375097 - DNA, 582 bp, Homo sapiens
  misc_feature: GZ8MTXP02GY18N.51.26.C04.1.454.CMB.2.raw
  modified_base (281)..(281): a, c, t, g, unknown or other
  modified_base (541)..(541): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggagtacaacatattacncagacgcgtgagggcatcacatctccagagacaagttccggaacacactgtctctgacaaatcgaacagcctagagagctggagacgagggtcttagtttatactgtgtgcgactccgactcgacgtcgggtacgggtagttacctccgtccgacgtacggtagtcggtacgtcgtcggggaccaacggggaccacggtccaaccgtctaccgttacgccctaccgaccgaacgggtcccacgtccgtcccttcccccgngccctaacccgtcctacgacgcgcccaccgtcggaccgggg

SEQ ID NO: 375098 - DNA, 636 bp, Homo sapiens
  misc_feature: GZ8MTXP02HXIIF.51.26.C04.1.454.CMB.2.raw
  modified_base (262)..(262): a, c, t, g, unknown or other
  modified_base (313)..(313): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtccctcagactctcctgtgcagcctctggcttcaccttcgaactaactttaatatgcacgtgggtgcgccgggctccaggcgaaggggctggagtgggtgctgttatacttngatggagtacaacatatactcagacgccgtggagggcatcacatctcaganacaagtccggaacactactgtctctagacaaatcgaaacacgcctagagagctggaaggacgagggtcttagtttatacgtgtgtcgacgtactacccgacctcgtacggttacggggtaacgggggtactttaacccgttccgtacccgacgtaaaccggttagtacgggtaccgtacgggtcgggggaccgaaacggggacccgacggtccgaccgtccttaccgtacgccctaccgaaccgacggccctacgtccggtccctcccccgtggacccctaaccccgtccctaccgaacgaccgccctaccgtcggaccgggg

SEQ ID NO: 375099 - DNA, 634 bp, Homo sapiens
  misc_feature: GZ8MTXP02G0AEB.51.26.C04.1.454.CMB.2.raw
  modified_base (454)..(454): a, c, t, g, unknown or other
  modified_base (509)..(509): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccacatcacctgctctggagattaagtttggggtactaagttattgtttcgtggtatcaacatccacccaggcccggtccccgatactcgctcctctatccatgatcgaccaaggccggccctcgaggggacctccccgtgacgtcgtacttccgtcgtcggtacctacctaacgttcgtcgggggacacgacgtacccactacgtacgacccaacgtcccggaccgggacccacggcgtgtcggagtcgnggtcctagtactaaattccgtaggtccgtagggtaccggtggggaacgagggggngtccggtggtcggtacggtttcggggacggggtacggaaccgtggtcctcgggtaccgtaccggtacggttacgaccggtaccgaacggtccgtccgcccccgtgtccgtactccgttacccccg

SEQ ID NO: 375100 - DNA, 635 bp, Homo sapiens
  misc_feature: GZ8MTXP02IR16I.51.26.C04.1.454.CMB.2.raw
  modified_base (154)..(154): a, c, t, g, unknown or other
  modified_base (279)..(279): a, c, t, g, unknown or other
  modified_base (286)..(286): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggagtccctnagactctcctgtgcagcctctggcttcaccttcgaactaactttaatatgcacgtgggtgcgccgggctccgaggcgaaggggctgggagtgggtgcttagttataacttctgatggagtacaanatatacncagacgccgtgacgggcctatcactatctacagagacaagttaccgggacactactgtctactagaccaaatccgaaacacgtccgtagagagcgtgaagggtacaggggtcttagtttatacgtgtcgtgcgtaactccgaacctgacggtgggttaacgggtacgtttaaccttccgtaccggtacgtacggttacgtcgggtcgaaacggtttcgggggaacctaccgggaaccgtaccgtccgtacctaccgttccgtaccgccctaaccggacccgtaacggccctcgtcccgtcccgtcccgccctccgaaccctacgacgacgacgcccttacgcggaccgg

SEQ ID NO: 375101 - DNA, 582 bp, Homo sapiens
  misc_feature: GZ8MTXP02HN00S.51.26.C04.1.454.CMB.2.raw
  modified_base (374)..(374): a, c, t, g, unknown or other
  modified_base (443)..(443): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttataacttctgatggaggtacaacatatactcagacgccgtgagggccgatcaccatctccagagacaagtccgggaacacactgtctctgacaaatcgaaacagcctgagagctggaggaacnggggtcttgtttatacgtgtgtgcgactccgactcacgtgggtacgggtattactccgtcgcaacggtncggtacgtcgtacggggacaacgggaccgaggtccaccgtcttccgttacgccctaccgaccgacggccctacgtcccggtcccttcccccgtacggcccaaccccttccgtaccgacgacgcctaccgtcggccgggg

SEQ ID NO: 375102 - DNA, 652 bp, Homo sapiens
  misc_feature: GZ8MTXP02JB433.51.26.C04.1.454.CMB.2.raw
  modified_base (179)..(179): a, c, t, g, unknown or other
  modified_base (227)..(227): a, c, t, g, unknown or other
  modified_base (388)..(388): a, c, t, g, unknown or other
  modified_base (600)..(600): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggactccctggccgcctatgacctgactcacgccaccctnagtgtccgtgtccccaggacagacacgccaccatcactgctcgtgganattagttgggtctaagtattgttcgtggtatcaacactcacccgaggcccggtcccgatacctgcctcctctatctatgactcgaccgaagccggtccctacgacgggtactcccgtgacgcgtacttcctcgtcggtcctactaacgtcgtcggggaacncgacgccctactccgtacgacccgacgtcccgggaccgggacccgtagggtccgtggtaggacgttcgggaacgtcgtacgtaacttacgttaacgtcggtacggtaggggtccgggtaggggaacggtagggggacgtcggtcggtacggttcggtttcggggacggtacgggtaccacggtacctcgggtaacccgtcggtacggtaccnccggtacccgaaggtcccgtccgtccccgtcggtcctccgttcctttccccg

SEQ ID NO: 375103 - DNA, 574 bp, Homo sapiens
  misc_feature: GZ8MTXP02JA8C5.51.26.C04.1.454.CMB.2.raw
  modified_base (261)..(261): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaaggggctggagtgggtggctgttataacttcngatggaggtacaacatatactcagacgccgtgagggccgattcaccatctccagagacaattccgggaacacactgtctctgcaaatgaacagcctgagagctgaggacagggctgtttattactggtgtgcgatccgacctcactggtacggggtacgttaacgttcctccgtcaacggttatcggtacgtcgtcggggaccaacggggaccgacggtcgaccgtctcttacgccgtccaccgacggccactccggtccttcccccgtcggccaacccctcctacccgacgacgtaccaccgtcgtccgggg

SEQ ID NO: 375104 - DNA, 611 bp, Homo sapiens
  misc_feature: GZ8MTXP02HI80T.51.26.C04.1.454.CMB.2.raw
  modified_base (506)..(506): a, c, t, g, unknown or other
tcagcgatcgtatacacgaccggtgctcgatttagtctagcgactttgggtttggggctgggcctcaggaagcagcatcggaggtgcctcagccatggcatggatcccctctcttcctcggcgtccttgcttactgcacaggatccctggccgcctatgacctgactcagccaccctcagtgtccgtgtccccaggacagacagccaccatcacctgctctggagataagttggggtctaagtatgttcgtggtatcacatcaccaggccggtccccgatactgctcctctatcatgatgccaagcggccctcgagggactcccgtgacgcgacttctctcggctaccgaacttcgtgggggacacgacgccactctcgacccacgtcccgaccgggacccagggcctggtggatggaggtctaggacttattacgttgtcgtaagggccggtggggaaccgaggggaggtcgtggacgtgttttcggggacgggacgggtaaccnggttccgtacggtacccggttaccgtacgggtacccgacggaccccgaaagggtcccgtcccggtcccccgttacgggtcccctaaccgttcccgtttcccccgg

SEQ ID NO: 375105 - DNA, 759 bp, Homo sapiens
  misc_feature: GZ8MTXP02G6876.51.26.C04.1.454.CMB.2.raw
  modified_base (271)..(271): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagattaagttggggtactaagtattgtttcgtggtatcaacatcacccncggccggtccccgatactgctcctctatcatgatgccaagccggccctcgacgggactcccgtagcgacgtacttcctctcgggcctccctaaaccttcgtcggggggaccaaccgacggacccctaaccgtcttacggaacccacgttaccccgggccccgggggaaccccgtaacggggcccgtggttaggggaacgttcgggaaacggggtcgttacggtaaccttaaagtttaccgttacggttaccggtacgggggtacccggggtttaggggggtaacccggaaaggggggttaaccgggcggttacggggtccggtttaacggtttttccgggggaccggggtaacgggggtacccggtaacggttccggtacgggtaccccggttacccggttacggtaccgtaaccggccccggtaaaaccggtccgtaccccggtccccccggttccggggtacctaccccgttacggtttcccccgg

SEQ ID NO: 375106 - DNA, 578 bp, Homo sapiens
  misc_feature: GZ8MTXP02FITPP.51.26.C04.1.454.CMB.2.raw
  modified_base (542)..(542): a, c, t, g, unknown or other
  modified_base (547)..(547): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaactttaatatgcactgggtgcgccgggctccaggcaaggggctggagtgggtgctgttataacttctgatggaggtacaacatattactcagacgccgtggaggggccgattcaccatctccagagacaattccgggaacacactgtctctgacaaatcgaacagacctgagagctgaggacgagggctgtttatactgtagtgacgactccgacctcacgtcgggtacggggtacgttacgttcctccgacaacggtatggtacgtacgtcgggggaccgaacggggaccacggtcgaccgtctccttacgccctaccgaccgacggcccagtccgtccttcccccgngcccnccctcctaccacgacgcaccgtcgtacgggg

SEQ ID NO: 375107 - DNA, 714 bp, Homo sapiens
  misc_feature: GZ8MTXP02IY97S.51.26.C04.1.454.CMB.2.raw
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccacctcagtgtccgtgtccccaggacagacagccaccatccacctgctcgtggatattaagtttggggtactaagttattgtttcgtggtatcaacatcaccacggccgtccccgatacctgcctcctctatcgactgatcgaccaacggccggtccccgtcgacggtactacccctgacgtcgtacttcgtcgtcggtctaccgtaactcgtcgggggacacgacgccacctcgtacgaccacgtcccggccggacccgacggcctaggtggacgtggacggtcgtacggtacttacttaccgttacgtaccggtagggtcccgggttagggggaaccggacgggggtacgggtacgtacgggtcgggttacggttttacggggacgggggacggggtaccgtaacgggtccggttaccgtaaacccggttccggttaccggttaaccgacccggttaacccccggaacgggtaccccgttcccgggtaaccccccggtttaccggggtcccctaacccgggtttacccccttttacccccgg

SEQ ID NO: 375108 - DNA, 649 bp, Homo sapiens
  misc_feature: GZ8MTXP02FVGIN.51.26.C04.1.454.CMB.2.raw
  modified_base (379)..(379): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtcgtccgtactccccaggacagacagccaccatccacctgctctggatattaagttggggtactaagtattgttcgtggtatcaacatccacccaggcccggtcccgatactcgcctcctctatcatgatcgcaagccgccctcgagggtactcccgtgacgcgtacttctcgtcggcctcctaacgtcggtcggggacncgacgcccacttcgacgacctacgtcccgggacccggacccgaggtccgtgtagggactggaggtcgtacggtacttagtttacgacggttcgacgggggtacggttacgggggaacgggtaacgggggacggtcggttacgggtaacggtttcgggtttaccgggggacggggttaaccgggaccgtacggtcgtacggacccgtttacggacggttaccgcggaccgtaacgccgttaccgccccgtcgtacctccgtctttccccgg

SEQ ID NO: 375109 - DNA, 586 bp, Homo sapiens
  misc_feature: GZ8MTXP02IOV90.51.26.C04.1.454.CMB.2.raw
  modified_base (257)..(257): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtgcgccgggctccaggcaagggctggagtgggtgctgttatacttngatggagtacaacatatactcagcgccgtgagggcattcaccatctccagagacaagttccggaacacactgtctctgacaaatgaacagcctgagagctggagacaggggcttgttattacgtgtagtgacgtactccgtacctcgacgtcgggtaacggggtagtttaccctcctccgacgtaaccggtagtcgggtacgtcgtcgggggaccaacggggaccacggtcgaccgttctaccgtcgaccctccaccgaacgggccctagtccggtcccttccccgtcggcctaacccgtcctaccgacgaccggcaccgtcgtcgggg

SEQ ID NO: 375110 - DNA, 551 bp, Homo sapiens
  misc_feature: GZ8MTXP02JWYS9.51.26.C04.1.454.CMB.2.raw
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtgctgttataacttctgatggaggtacaacatattactcagacgccgtggaggggccgattcacactctccagagacaattaccgggacacactgtctctgacaaatgacagccgtgagccgctgaggactaggggctgtttattactgtgtgcgatccgacctgactggtacggggagttacgttcctaccgcaacggtatggaacgtctagggggccagggccacggtcaccgtctccttagcctccaccaggcccatccggacttcccccacggtcaaccctctccacgacgcaccgtcacgggg

SEQ ID NO: 375111 - DNA, 717 bp, Homo sapiens
  misc_feature: GZ8MTXP02IZBRV.51.26.C04.1.454.CMB.2.raw
  modified_base (268)..(268): a, c, t, g, unknown or other
  modified_base (292)..(292): a, c, t, g, unknown or other
  modified_base (362)..(362): a, c, t, g, unknown or other
  modified_base (379)..(379): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtccctcagactctcctgtgcagcctctggcttcaccttcgactaacttttaatatgcacgtggggtcgcggccgggctccgaggcgaaggggctgggagtgggtgcttgttatacttngagtggaagtacaacatattactnagacgccgtggacggggcctatccaccatctccagacgaacctaagttaccgggaacaccacttgtcctntgactaaagtcgaaacngcctaggagacgctgggaaggacgtaggggtctttaggtttatttacgtggtgtgccgtactccgtacctcgtaacggttcggggtaacggggttctttaaccgtcccgtacggacgtaaacggttcgtacggaccggttcggaccgggggtaaccgaaccggggtaaccgtacgggtccctaaccgttccgttacccgtaacgtcccccgttaaccgaacccggtaccggggtacccctacggttccccggtttaccccctcccccgtacggtaccccctaacccctttacccggaaccgtaccgaccgtacccgtaacccgtcgggggtcccgggg

SEQ ID NO: 375112 - DNA, 613 bp, Homo sapiens
  misc_feature: GZ8MTXP02FHJ36.51.26.C04.1.454.CMB.2.raw
  modified_base (258)..(258): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgtataacttntgatggagtacaacatattactcagacgccgtgagggccgatcacatctccagagacaagttccgggaacacactgtctctgacaaatcgaaacagcctgagagctgaggacagggcttgtttaattactgtcgtgcgactccgactcacgtgggtacggggtagttacttcctccgacgaacggtatcggacgtcgtacgggggaccaaacgggtaccgacgggtctaaccggtccttacccttacggtcccctaccgacccgaaacggggcccctaacggtaccgggttccctttcccccgcggtcccaaccccttacccgacccaaacgacgaccacccgtcggtccggggg

SEQ ID NO: 375113 - DNA, 685 bp, Homo sapiens
  misc_feature: GZ8MTXP02IGCP3.51.26.C04.1.454.CMB.2.raw
  modified_base (266)..(266): a, c, t, g, unknown or other
  modified_base (278)..(278): a, c, t, g, unknown or other
  modified_base (282)..(282): a, c, t, g, unknown or other
  modified_base (289)..(289): a, c, t, g, unknown or other
  modified_base (344)..(344): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgaactaactttaatatgcacgtgggtgcgccgggctccgaggcgaaggggctgggagtgggtggctgttataacttngagtggacgtanaacntattacnagcgcgtggagggcctatcacatctcagagacagtaccggaacacactgtctacngacaaatacgaacacgcctggaagacgcgtaggggacggaacgtacggggtctttaggtttacttagtggtgttgcgtactaccgtaccctcgacggttacgggggttaacgggtacgtttacccgttccgtaccggaaccgttaaacggttacgtacgggtaaccggttcgggacggggtaaccggaccggggttaaccaccgggttcctacccggttcctccgttaccgacccttaccaacggtaaaccgggccctacgttcccggtttccctccccggtacgtcccctccccgttacccgaaccgacgaccgtacccgtaccggtccggtaccggggg

SEQ ID NO: 375114 - DNA, 625 bp, Homo sapiens
  misc_feature: GZ8MTXP02HK263.51.26.C04.1.454.CMB.2.raw
  modified_base (204)..(204): a, c, t, g, unknown or other
  modified_base (255)..(255): a, c, t, g, unknown or other
  modified_base (268)..(268): a, c, t, g, unknown or other
  modified_base (610)..(610): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtccctcagactctcctgtgcagcctctggcttcaccttcgaactaacttttaanatgcacgtggggtgccggccgggctccgaggcgaaggggctgggagtgggngctgttatacttngagtggagtacaactatatactcagcgcgtggacgggcatcacatctacagagacaagtaccggaacacactgtctctgaacaatcgaacagctagagagtctgggacggacgtacggggtctttaggtttactacgttgtcgtacgacgtactcccggtacttccgaacggttcggggtaacggggttactttaccgtccgtacgacgtaacggtgtcgggtacgtcggtacgggggaccaacgggacccgtaccggctaccggtccttaccgtacgccctaccgaccgtacggccctacggtcccggtcccttccccgcgaccctccgtcctacgacgcnccctacgtcggccgg

SEQ ID NO: 375115 - DNA, 586 bp, Homo sapiens
  misc_feature: GZ8MTXP02F6M0A.51.26.C04.1.454.CMB.2.raw
  modified_base (201)..(201): a, c, t, g, unknown or other
  modified_base (259)..(259): a, c, t, g, unknown or other
  modified_base (282)..(282): a, c, t, g, unknown or other
  modified_base (307)..(307): a, c, t, g, unknown or other
  modified_base (312)..(312): a, c, t, g, unknown or other
  modified_base (572)..(572): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaactttaanatgcactgggtgcgccgggctccgaggcaaggggctggagtgggtgctgttatacttntgatggaggtacaacatattacncagacgccgtgagggcatcacatcncaganacaagttccggaacacactgtctctgacaaaatcgaaacagccgtagagagctgagacgagggtcttagtttaatacgtgttagtgacgtagtccgacctcgtacgtggggtacgggtacgttaccttccgtcgacgaacggtagtcggtacgtcgtacgggggaccgaaacgggaccgacggtcctaccgtcctccgttacgccctaccaaccgacggcccagtccgtcctccccgtgccctaaccgcctaccacgacncaccgcgtacgggg

SEQ ID NO: 375116 - DNA, 691 bp, Homo sapiens
  misc_feature: GZ8MTXP02IR0Q0.51.26.C04.1.454.CMB.2.raw
  modified_base (152)..(152): a, c, t, g, unknown or other
  modified_base (177)..(177): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccncctatgacctgactcagccaccctnagtgtccgtcgtccccaggacagacagccacatccacctgctcgtggagtattaagttttggggtacttaagtattggtttcgtggttactacaacactccgaccccgacgggccccggtccccgaattacctcgccttccctctatcgatgactagccaagcccggtccctagacgggtactcccgtgaacgtctacttcctcgacggtcctacctaaccgttggtccggggacaccgacgacccctacgtccgacgacccacgtccggacccggacccgtaggccgttaggtaggtacgtgaacgtcgtagacgttacttacgtcggtacgtacgggtcgggtacggggaacgaggggtcgtcggttacgacgggtttacgtttacggggcggggtaacggtaccgacggttcggtaccggtacccggtaccggtttacgacccgaccggtaccggtaaccggtcccgtcccggtacccccttaggtacccgtccgtaacccgtttccccgg

SEQ ID NO: 375117 - DNA, 586 bp, Homo sapiens
  misc_feature: GZ8MTXP02FIAHH.51.26.C04.1.454.CMB.2.raw
  modified_base (257)..(257): a, c, t, g, unknown or other
  modified_base (539)..(539): a, c, t, g, unknown or other
  modified_base (567)..(567): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgacaactttaatatgcactgggtgcgccgggctccaggcaaggggctggagtgggtgctgtatacttntgatggaggtacaacatattactcagacgccgtgaggggccgattcaccatctccagagacaagttccgggaacacactgtctctgcaaatcgaacagcctgagagctgaggacagggcttagtttatactgtgtgcgtactccgacctcgacgtggggtacggggtatttacctccgtccgacgaacggtatcgggacgtcggtggggaccaacgggaccacggtccaccgtctaccgttacgccctaccacgaacgggcccagtccggtcccttccccgnggtccaaccccgtcctacccgaacgacncctacccgtcggtcggggg

SEQ ID NO: 375118 - DNA, 570 bp, Homo sapiens
  misc_feature: GZ8MTXP02GD559.51.26.C04.1.454.CMB.2.raw
  modified_base (258)..(258): a, c, t, g, unknown or other
  modified_base (314)..(314): a, c, t, g, unknown or other
  modified_base (338)..(338): a, c, t, g, unknown or other
  modified_base (449)..(449): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcaaggggctggagtgggtggctgttatacttntgatggaggtacaacatattactcagacgccgtgagggccgattcacatctcaganacaagtccggaacacactgtctcngacaaatcgaacagcctagagacgctggaggacgaggggtccttgtttattactgtgtgcgactcccgtactcacgtgggtacgggtacttacgttcctccgagaacggtntcgggacgtcgtaggggccaaagggcctacggcctaccgtctaccgttcgcctccacgtaacggcctacgtccgtccctccccgtgcccaacccgtccacgacgacgccaccgtcgtcggg

SEQ ID NO: 375119 - DNA, 639 bp, Homo sapiens
  misc_feature: GZ8MTXP02FIF53.51.26.C04.1.454.CMB.2.raw
  modified_base (213)..(213): a, c, t, g, unknown or other
  modified_base (261)..(261): a, c, t, g, unknown or other
  modified_base (285)..(285): a, c, t, g, unknown or other
  modified_base (345)..(345): a, c, t, g, unknown or other
  modified_base (370)..(370): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactgggtncgccgggctccgaggcaaggggctggagtgggtggctgttataacttntgatggaggtacaacatattactnagacgccgtgacggggcgattcaccatctccagagacaattccgggaacacactgtctcngacaaatcgaacacgcctgagacgntgaggacagggcttgtttatctgtgtgcgactccgacctctacgtggggtaacggggtacgtttacttccgtccgacgtaacggtagtcggtaccgttcgtcgggggaccaaacggggacccaacgggtccacccggttcctacccgtttacgcccgtacccgacccgaacgggccccctaacgttccgggtaccccttcccccgtcgggacccctaaccccgttccctaacccgaaacgtaccgaccgtaacccgtcggtaccggggg

SEQ ID NO: 375120 - DNA, 616 bp, Homo sapiens
  misc_feature: GZ8MTXP02ID2VX.51.26.C04.1.454.CMB.2.raw
  modified_base (177)..(177): a, c, t, g, unknown or other
  modified_base (222)..(222): a, c, t, g, unknown or other
  modified_base (302)..(302): a, c, t, g, unknown or other
  modified_base (427)..(427): a, c, t, g, unknown or other
  modified_base (433)..(433): a, c, t, g, unknown or other
  modified_base (439)..(439): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtccgtgtccccaggacagacagccacatcactgctctgganatacgtttggggtactaagtattgttcgtggtatcaacatcacccgaggcccggtacccgatactgctcctctaatctangtatcaccgtaagccgtaccctgacgggacttcccgtagacgtctatcctcgtcggcctacctaacgtcgttgggggaaccacaaccgcctaccgttcgagacccaacgtcccggcggaacccgnggtacngtaggngtacggcgtcgtacgtacttagttcgtgtacgtacgggcggtagggacggaggagtcgtggtcgttacggttcgggacggtacggtacgtacgtccgtaccgtaccgtacgtacggtaccgtaaccggccgtaaccgtcccgacccgtacccgtccgtccgtaccgttcccgtcccg

SEQ ID NO: 375121 - DNA, 650 bp, Homo sapiens
  misc_feature: GZ8MTXP02F6S0D.51.26.C04.1.454.CMB.2.raw
  modified_base (177)..(177): a, c, t, g, unknown or other
  modified_base (275)..(275): a, c, t, g, unknown or other
  modified_base (356)..(356): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtccgtgtcccaggacagacagccacatccacctgctctaggatattaagtttggggtactaagtattggtttcgtggtatcaacatccacccgnggcccggtcccgatactgcctctctatcatgatcgactaacgccggccctgacgggtactcccgtgacgtcgtactttccncgtacggccttacccgaacgttcggtacggggaccacgtacggccctactcgtacgaccctacgtcccgggacccggacccgacggtcgtgggtacgcgtaggacggtcgtacgtacttacgttacgtggacggtagggcgggtacggggacgtaggggcggtcgtacgggtcggttaggtttcggggacgggtacgggtaccgacggttcgtacggtacccgtcgtacggtacgaccggtaccgaaccggtccgtcccgtcccccgttacggacctaccgttcccgtttcccg

SEQ ID NO: 375122 - DNA, 614 bp, Homo sapiens
  misc_feature: GZ8MTXP02JICIX.51.26.C04.1.454.CMB.2.raw
  modified_base (308)..(308): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaacttttaatatgcactggggtgcgccgggctccaggcaaggggctggagtgggtgctgttatacttctgatggagtacaacatattactcagacgccgtggagggccgattcaccntctccagagacaagttccggaaacacactgtctctgactaaatcgaacacgcctaggagagcgtgggaagacgaggggtcttaggtttattacgtgtgtgcgactccgactcgacgtcgggtacggggtactttaccgtcctcgacgtaacggtcgtcggaccgtgacggggaccaacgggacctacgggtccaccgtccgtccgtacgccctacccgaaccgaccgggaccctagtcccggtacccttccccgtggtacccctaacccgtccctaccgacgacgacctacccgtcggtaccgggg

SEQ ID NO: 375123 - DNA, 610 bp, Homo sapiens
  misc_feature: GZ8MTXP02FODVT.51.26.C04.1.454.CMB.2.raw
  modified_base (563)..(563): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggacggtccctcagactctcctgtgcagcctctggcttcaccttcgacaacttttaatatgcactgggtgcgccgggctccaggcaaggggctgggagtgggtgctgttataacttctgatggaggtacaacatattactcagacgccgtgaggggccgattcaccatctccagagacaattccgggaacacactgtctctgcaaatgaacagcctgagagctgaggacagggcttgtttattactgtgtgcgatcccgactcacgtgggtacggggtacgttacttcctccgacgaacggtagtgggaacgtcggtgggggacccgaacggggacccgacgggttcctaacccggtccttaccgttacgaccccgtccaacccggaaacgggccctacgtccgttcccttcccccgngccctaaccccgtcctaccaacggcgacccaccgtcggtaccggggg

SEQ ID NO: 375124 - DNA, 593 bp, Homo sapiens
  misc_feature: GZ8MTXP02IFE08.51.26.C04.1.454.CMB.2.raw
  modified_base (335)..(335): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcacctttcgacaacttttaatatgcactgggtgcgccgggctccaggcaaggggctgggagtgggtggctgttataacttctgatggaggtacaacatattactcagacgccgtgaggggccattccaccatctccagagacaagttccggaanaccactgtctctgacaaatcgaacagcctgagagctgaggacagggtcttgtttatactgtgtgcgatccgactcacgtgggtacggggtacgttacttcccgtcgacgtaacggtatgggtacgtcgtacgggggaccaaacgggaccacgggtcaccggttctccgttacgccctccgaccgaacgggccctacgtccgttccttcccccgtggcccctaaccctcccgtaccaacgaccgtcaccgtcgtcgggg

SEQ ID NO: 375125 - DNA, 733 bp, Homo sapiens
  misc_feature: GZ8MTXP02IUIUB.51.26.C04.1.454.CMB.2.raw
  modified_base (257)..(257): a, c, t, g, unknown or other
  modified_base (347)..(347): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgactaactttaatatgcactgggtgcgccggctccaggcaaggggctggagtgggtgctgttatacttntgatggagtacaacatatactcagacgccgtggagggccatcacatctcagagactaagtccggaacacactgtctctgacaaatcgaanacgcctagagagctgagacgaggtcttagtttaatacgtgtgtgccgtatcccgaccttagacgttaggggtaccgggtaattcccgttacccgaccggtacgtaaaccgggttagtaccgggggtacgtaccgggtacgggggaacccgtaaaacgggggaccctaacccgggggttaccctaaacccgggttcccgttacccgtttaaaaccgggcccccttaacccccggtaaaacccggaaaacccgggggtcccccttaaaccggtttacccccgggtttacccccgtttccccccccggaagggtccccctaaaccccccggttcccttacccgaaaaacggccgtacccccgtaaacccggttcccggtaacccggggg

SEQ ID NO: 375126 - DNA, 636 bp, Homo sapiens
  misc_feature: GZ8MTXP02F2NLO.51.26.C04.1.454.CMB.2.raw
  modified_base (225)..(225): a, c, t, g, unknown or other
  modified_base (409)..(409): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacacgccaccatcacctgctctgganattaagttggggtactaagtattgtttcgtggtatcaacatcaccgacggccggtcccgatactcgcctcctctatcatgatcgaccaacgccggccctcgacggggtactcccgtagacgtcgtacttccgtcgtacggtcctaccgtaaccgtgtcggggacacgacgcccactctcgaccncgtccgccggaccgaggcgtggtgagtggacggctagtacttagttacgtggtacgtagggtcggtaggggacggacggggacggtcggtcggtacggttacggtttaccggggacgggtaacgggtacgtacgggttccgtacggtacccggttaccgttacggtaccgaccgaccggaacgtcccgtacccggtcccccgtcggtcctaccttccggtttccccg

SEQ ID NO: 375127 - DNA, 638 bp, Homo sapiens
  misc_feature: GZ8MTXP02FSGFY.51.26.C04.1.454.CMB.2.raw
  modified_base (177)..(177): a, c, t, g, unknown or other
  modified_base (243)..(243): a, c, t, g, unknown or other
  modified_base (250)..(250): a, c, t, g, unknown or other
  modified_base (259)..(259): a, c, t, g, unknown or other
  modified_base (267)..(267): a, c, t, g, unknown or other
  modified_base (284)..(284): a, c, t, g, unknown or other
  modified_base (291)..(291): a, c, t, g, unknown or other
  modified_base (294)..(294): a, c, t, g, unknown or other
  modified_base (326)..(326): a, c, t, g, unknown or other
  modified_base (340)..(340): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctnagtgtccgtgtccccaggacagacagccacatcacctgctctggatattaagttgggtactaagtntgttcgnggtatcaanatcaccgnggcccgtacccgatacngctcctntancatgatgaccagccgcctcgagggtactccgngacgcgtacttccncgtcgcctacctaacgtcgtcggggaccacgacggtaccctacgttcgacgaccctaacgtcccgggacccggacccgtaggtcttagggtacgagttcggacgtctacggtacttaacgttcgtagtcggacggggtcgtaagggggaccgtaaggggcggtacgtggtaccgggttaagtttccgggggaacgggaacgggtaccgtgggttacccacgggtacccggttacgtacggtccacggacccggaacgtccgtaccggtcccccgtgtacctccgtcggtttacccccg

SEQ ID NO: 375128 - DNA, 654 bp, Homo sapiens
  misc_feature: GZ8MTXP02H1QF6.51.26.C04.1.454.CMB.2.raw
  modified_base (361)..(361): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctggggaggtccctcagactctcctgtgcagcctctggcttcaccttcgacaacttttaatatgcactgggtgcgccgggctccaggcaaggggctggagtgggtggctgttataacttctgatggaggtacaacatattactcagacgccgtgagggccgattcacatctccagagacattccgggaacacactgctctgacaaatcgaacagcctganagctgaggacagggtcttgttattactgtgtgcgatcccggacctcgtacgtggggtacgggtacgttacttcccgtcgacgtaacggttagcgggtacgttccggtagggggacccgtaaagggggacccctacgggtacccgtacccggttacccttaccctttacgccccgtacccgaaaacccgtaaccggggcccctaacggtcccggttcccctccccccgttaacggcccctaacccccttacccgtcccaaaacggtacgcccctaacccggttcgtccgggggg

SEQ ID NO: 375129 - DNA, 610 bp, Homo sapiens
  misc_feature: GZ8MTXP02F0LK9.51.26.C04.1.454.CMB.2.raw
  modified_base (284)..(284): a, c, t, g, unknown or other
  modified_base (308)..(308): a, c, t, g, unknown or other
  modified_base (313)..(313): a, c, t, g, unknown or other
  modified_base (334)..(334): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctcagactctcctgtgcagcctctggcttcaccttcgacaactttaatatgcactgggtgcgccgggctccaggcgaaggggctggaggtgggtggctgttataacttctgagtggagtacactatattacncagacgcgtgagggcatcacatcncaganacataccggaacacactgtcnctagacaaatcgaacacgctagagagctaggactacggagggtcttagtttactacgtggtagttcgcgtactccgacctcgtacggtacgggtacgggtacttacctccgccgtagtacggtagtcggacgttcggacgggggaccgtaaccggcgtaccggtccaccgtctaccgtacgtccccaccgtaccgacggccctaagtcccggttcccttaccccgcggacccctaaccccttccaccgaaacgtccgaccctaccgtcggacgggg

SEQ ID NO: 375130 - DNA, 784 bp, Homo sapiens
  misc_feature: GZ8MTXP02HMHST.51.26.C04.1.454.CMB.2.raw
  modified_base (179)..(179): a, c, t, g, unknown or other
  modified_base (247)..(247): a, c, t, g, unknown or other
  modified_base (264)..(264): a, c, t, g, unknown or other
  modified_base (295)..(295): a, c, t, g, unknown or other
  modified_base (297)..(297): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggactcccgtggccgcctatgacctgactcagccaccctnagtcgtccgtcgtccccaggacagacacgccacatcacctgctctggatattaagttgggactaagtnttgttcgtgtatcaacnctccgaccaggcccgtcccatcctgctcctntntcatgatcgaccacgcccggtccctaggacgggtaccctcccgtggacgccgttacttccgtacgtccggaccttaccaaaccggttgtccgggggaaccaccgaccggtaccctacgttaccgaccggtaacccacgggttcccccggggaacccggggtaaccccgacggggttcccgttacggggttaaacgggaggttacgggtaaccggggtccttaaacggtttacctttaaaacgttttacccgtcggggtttaaccccgggggtacgggggttaccggggtaacgggggtacgggtaacgggggttccggttacgggttacgggtttaccggggtttacggggtttaccgggggaaccggggttaccggtaccggtcggttaccgtaccggttaccggtaccgtaccggtaccgaccgtaccggtaacccgtcccgtacccggttccccgtaccgtccctaccgtttccccgtaccccg

SEQ ID NO: 375131 - DNA, 810 bp, Homo sapiens
  misc_feature: GZ8MTXP02F9SMV.51.26.C04.1.454.CMB.2.raw
  modified_base (265)..(265): a, c, t, g, unknown or other
  modified_base (282)..(282): a, c, t, g, unknown or other
tcagcgatcgtatacacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctcagactctcctgtgcagcctctggcttcaccttcgactaactttaatatgcacgtgggtgcggccggctccaggcgaaggggctgggagtgggtggcttgttataacttntgagtggaggtaacaanataattactcgaggaccggtccgtaggacggggccgtattcccaacctatacctccaaggaacgaactaaacgttaccgggaacaacgtaccgttgtacctacgtacaaactaaacgtaccgaaaaccgacgtaccgtagaacgacggtccgtaggaacgggaaccgggtacggggttaccgtttagtttttaacgtttacgttagggttcggtacgaaccgttacgtaccccgtaaccgttaccgtaccgggttacgggggttaaacgggttaccgtttacccgtttacccggtacccgtaaccgggttaaacggttaaggttcccgggggtaccgttaccggggtacgggggaacccgtaaaccggggtacccggtaccggttacccgttaaccccgtccgtttaccgttaaccgcccctaccggaacccgaaaccggtcccctcgttacccggttacccctcccccgcggtaccccctaacccgtcccgtaaccgacgtaccgccgtaccgttccggggaccggg

SEQ ID NO: 375132 - DNA, 689 bp, Homo sapiens
  misc_feature: GZ8MTXP02JTTPO.51.26.C04.1.454.CMB.2.raw
  modified_base (426)..(426): a, c, t, g, unknown or other
  modified_base (458)..(458): a, c, t, g, unknown or other
tcagcgatcgtatacacgaccggtgctcgatttagtctagcgactttgggtttggggctgggcctcaggaagcagcatcggaggtgcctcagccatggcatggatccctctcttcctcggcgtccttgcttactgcacaggactccctggccgcctatgacctgactcagcccaccctcagtcgtccgtgtccccaggacagcagccaccatccacctgctcgtggagtaattaaggtttggggtactaaggttattggtttcggtggtactacaactatccacccgacgggcccggtccccagtacctcgccttcctctatctagtgactgacctaacggcccgtccctacgacgggtactacccgtggacgcgtaccgttctcgtcgtacctcctaacgtcgggtggggaacacgacgcctacncgtacgacccacgtcccggacccggacccggnggtcgtggtacggtacgtcggacgtcgttacgtacgtttacgttacggtaggtacggacggggtacggacggggacggtagggcggtcggtacggtcggttcggttcggggacgggtacggtaccgtacggtcgtacggtacccgttacggtacgggtacccgacggtcccgggtaacggtccccgtaccccggtaccccgtccggtaccctacccgttacccgttccccg

SEQ ID NO: 375133 - DNA, 567 bp, Homo sapiens
  misc_feature: GZ8MTXP01CD5LS.13.28.C06.1.454.CMB.2.raw
  modified_base (370)..(370): a, c, t, g, unknown or other
  modified_base (464)..(464): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggtttccttgttgctatttagaaggtgtccagtgtgaagtgcacctggtggagtccgggggagacttggtccagccgtggggggtccctgagactctcctgtgtagcctctggatttgtttagtgactatggatgagttgggtccgcaggctcgagggaggggctggagtgggtgcaacataaagacgatgaagttgagataaattattggactntagtgaagggccattcaccatctcgagggacaacgccaaagaactcgctgtatctgacaaaatgggagagcctggagagccggaggacacgggntagtatattatgtgtgagttattacgcgtactactttacgtttgaaccgttaacggtcgggggaacccaacggggtaaccccttgggtaacccaacccgttcc

SEQ ID NO: 375134 - DNA, 610 bp, Homo sapiens
  misc_feature: GZ8MTXP01CQW42.13.28.C06.1.454.CMB.2.raw
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggaggtccgggggagacttggtccagccgtgggggtccctgagactctcctgtgtagcctctggatttgttttagtgactatggatgagttgggtccgccaggctccgaggggaggggctgggagtggggtggccaaagataaaggtacgatgaaagttgaagtattaaattatttggactcgtagtgaaggggcccgtaattcaccatctacggagggacaacgccaaagaactcgctgtaatctagacaaaagtggaagacgccggtggaaggacgcccggaagggacctacgggcttagtatattagttgtgtgagttattaggcgtactattaacgtttgaaccttaaggtcgggggaacccaagggggtaacccccttgggtaacccaacccggttccc

SEQ ID NO: 375135 - DNA, 577 bp, Homo sapiens
  misc_feature: GZ8MTXP01DT3JO.13.28.C06.1.454.CMB.2.raw
  modified_base (182)..(182): a, c, t, g, unknown or other
  modified_base (278)..(278): a, c, t, g, unknown or other
  modified_base (280)..(280): a, c, t, g, unknown or other
  modified_base (283)..(283): a, c, t, g, unknown or other
  modified_base (285)..(285): a, c, t, g, unknown or other
  modified_base (287)..(287): a, c, t, g, unknown or other
  modified_base (289)..(289): a, c, t, g, unknown or other
  modified_base (298)..(298): a, c, t, g, unknown or other
  modified_base (310)..(310): a, c, t, g, unknown or other
  modified_base (321)..(321): a, c, t, g, unknown or other
  modified_base (330)..(330): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgagcgtggttttcgtgtagctatttagaaggtntcagtgtgagtgcagctggtgagtcgtgggggagtcttgggtccaggccgtggggggtccccagctctctgtgcagctctggatctactagtagtntntgngngngngtggcgcgngcgcgaggaggngtggtggtggngacaacaanaagagtacgtaggagagaagtaagtaatagtgtgtacgtacgtgtacggacggacgtactacactactactacgacgaacgaacgaacgaacaacgaactactacgtagtagtacgtacgaacaaagtaacgaacgacgcgagacgacggacggacggacgacgtcgttcgttcttacgttacgtagtgaggaggttaggtaagggtaggggtaacgggtaaggtagttagtaacgttaaggtaacg

SEQ ID NO: 375136 - DNA, 594 bp, Homo sapiens
  misc_feature: GZ8MTXP01CFEWF.13.28.C06.1.454.CMB.2.raw
  modified_base (358)..(358): a, c, t, g, unknown or other
  modified_base (463)..(463): a, c, t, g, unknown or other
  modified_base (509)..(509): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctatttagaaggtgtccagtgtgaagtgcacctggtggagtccgggggagacttggtccaggccgtggggggtccctgagactctcctgtgtagcctctggtatttgttttagtgtactatggatgagctgggtccgccaggctccgaggggaaggggctgggaggtgggtttcgggtattaggtgctnttgatgatacgcacatactatgcaagactccggttaagggccgtcttcaccatcctaccagagacaattccaaagaccacgtctatatctagcagggatgaaacncggccgtggggcgaccggaagggaccgtaaccgggtccgttttaancctaacgtggttacggaacgaaagtattagtttagttaaagttgtaagtggtaacgtctgttacctaacgttaacttttaaccgg

SEQ ID NO: 375137 - DNA, 636 bp, Homo sapiens
  misc_feature: GZ8MTXP01DFGEG.13.28.C06.1.454.CMB.2.raw
  modified_base (284)..(284): a, c, t, g, unknown or other
  modified_base (499)..(499): a, c, t, g, unknown or other
  modified_base (513)..(513): a, c, t, g, unknown or other
  modified_base (530)..(530): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaacttgggttttccttgttgcttattttagaaggtgtcagtgtgaagtgcacgtggtggaggtccgggggagacttggtccaggccgtgggggtccctgagactctctgtgtagcctctggtatttgttttagngtacttatggatgagttgggtccgcgaggctcgaggggaggggctggagtgggtgaccaaatataaaaggtacgataggaaagttgaagtaaattaaaatttagtttcggactgttaggttaggaagggcccgtaattccaacctataccgtagggaacgggaaccaaaccgaccaaaagaactcggcttaggtaatcgtagacaaaagtggaanacgcgtaggagganccggaagtcccagggtntagtatattagtgagtaagattagttacgcgtaacctacgtttacgttgaccgttaacgggcggggtaaccaacgggtacccttcgggtaacccttaacccgttcc

SEQ ID NO: 375138 - DNA, 597 bp, Homo sapiens
  misc_feature: GZ8MTXP01C2SS6.13.28.C06.1.454.CMB.2.raw
  modified_base (342)..(342): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggaggtccgggggagacttggtccagccgtggggggtccctgagactctcctgtgtagcctctggtatttgttttagtgactatggatgagttgggtccgcaggctccgaggggaggggctggagtgggtgccaanataaagcgatgaagttgagattaaattatttggactcgtgtagaagggccattcacctatctcggagggacaacgccaaagacctcgctgtatctagacaaagtgggagacgccgtggaaggacgccggaaggtaccacgggtctagttattatttagttggtgtgtaagacttagcgtactaactttacgtttgaccgttaacggtcgggggcccaacgggggtaaccccttggggtaaccaacccggtttccc

SEQ ID NO: 375139 - DNA, 680 bp, Homo sapiens
  misc_feature: GZ8MTXP01E00MJ.13.28.C06.1.454.CMB.2.raw
  modified_base (342)..(342): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaacttgggttttccttgttgctattttagaaggtgtccagtgtgaagtgcacctggtggaggtccgggggagacttggtccagccgtggggggtccctgagactctcctgtgtagcctctggtattttgttttagtgactatggatgagttggtccgcaggctcgagggaggggctggagtgggtgaccaanaataaagtacgatgaagttgagtaattaaatttagtttgggacttcgtaggtgggaacggggtccgtaattccacctattccgtacgggaacggggaccaaaccgccctaaaaggaacctcgcttagtattccgtgacaaagtgggaagacgccgtaggaggacgcccggaagggaccgacgggtctagttaagttattttagtggttgtggtaagttagttaacggcggtaccttaaccgttacgttttttcggaacccgtttaaccgggtacggggggtaacccctaaacggggggtaacccccttggggttaaccccgttaaccccggtttcccg

SEQ ID NO: 375140 - DNA, 694 bp, Homo sapiens
  misc_feature: GZ8MTXP01EJX73.13.28.C06.1.454.CMB.2.raw
  modified_base (265)..(265): a, c, t, g, unknown or other
  modified_base (281)..(281): a, c, t, g, unknown or other
  modified_base (562)..(562): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcacatggaattgggctgaacttgggttttccttgttgcttatttagaaggtgtcagtgtgaagtgcacgtggtggaggtccgggggagacgttggtccaggccgtgggggtccctgagactctctgtgtagctntggtattttgtttagngtactagtggatggtaggttcggtccgcgaggctcggagggggaaaggggctggggacggtggggtacggacccgaaaataagtaaaaggtacgtaagttaggtaaagttggaaataaattaaagtttagtttaggacttacgtaagggtaggaacggggtcctaattccaacctagtcgtacgggaacgggaaccaaacggaccaaagtaactcgattagtacttcgtagactaaaagtgggaacacgcgtagaaggacgacccggtaaggacccaggtntttaaggtattaaagtttgttggtggttaagaaagttaccgttaaggccctattaaccttacgtttgaaaccgttcgggagggggaaccctaacggggtaacccccttgggtaaccccttaacccggttccc

SEQ ID NO: 375141 - DNA, 562 bp, Homo sapiens
  misc_feature: GZ8MTXP01C3R2C.13.28.C06.1.454.CMB.2.raw
  modified_base (261)..(261): a, c, t, g, unknown or other
  modified_base (277)..(277): a, c, t, g, unknown or other
  modified_base (325)..(325): a, c, t, g, unknown or other
  modified_base (331)..(331): a, c, t, g, unknown or other
  modified_base (374)..(374): a, c, t, g, unknown or other
  modified_base (448)..(448): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggtttccttgttgctatttagaaggtgtcagtgtgaagtgcacgtggtggaggtccggggagacttggtccagccgtgggggtccctgagactctctgtgtagctntggtatttgttttagngactagtggatgagtggccgcaggctcgagggaggggctggaggtggngccaanataaagtacgatggaagttgaagtaattaaattatttggactntaggtagaagggcctattcacatcgtacgagggaacaacgacaaagaactcgactagtatcagacaaagtgganacgcgtagaggagaccggaagtacacggcttagtatagttatgtgtgaagttctggcgtatactttacgttgactcggtgggcctaacgggacccttgggtaaccaaccgtccc

SEQ ID NO: 375142 - DNA, 626 bp, Homo sapiens
  misc_feature: GZ8MTXP01CZSMD.13.28.C06.1.454.CMB.2.raw
  modified_base (342)..(342): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggaggtccgggggagacttggtccaggccgtggggggtccctgagactctcctgtgtagcctctggtatttgttttagtgactatggatgagttggtccgcaggctccgagggaggggctggaggtgggtgccaanagtaaagtacgatgaagttgagtaattaaattagtttggactcgtaggtaggaagggtccgtattacgacctatcgtacgggaacgggaccaaaccggaccaaaggaactcggactaggttaactcgtagactaaaagtgggaagacgccgtaggacgaggccggaaggaccaacggggtcttaggtaattatttagttggtggtaagagatttagcgtctaattacgtttggacttaacggtggggcccaacgggggtacccttgggtcccaacccggttccc

SEQ ID NO: 375143 - DNA, 668 bp, Homo sapiens
  misc_feature: GZ8MTXP01A5315.13.28.C06.1.454.CMB.2.raw
  modified_base (287)..(287): a, c, t, g, unknown or other
  modified_base (468)..(468): a, c, t, g, unknown or other
  modified_base (524)..(524): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaacttgggttttccttgttgcttattttagaaggtgtccagtgtgaagtgcacctggtggaggtccgggggagacttggtccaggccgtggggggtccctgagactctcctgtgtagcctctggtatttgttttagngtactatggatgtaggttcgggtccgcgaggctaccggaggggaggggctggggaggtgggtcgaccaacagtaaagtacgatagaagttgagaattaaattgttggactgtaggtaggaagggtccgtattccactatcgtcggaagggaccaacgccgaaagactcgacttagtaatcngtaacaaagtgggaacgacggccgtaggaacggtacgcccgggaagaccgacggtntttaggttaattagttttagttcgggtaggtaagtaagttagtttacggccgttaaccgtaactttacggtttcgaacggtttccgggtgggggaacccctaacgggggtaccccttggggtaaccccttcccggtttaacccc

SEQ ID NO: 375144 - DNA, 603 bp, Homo sapiens
  misc_feature: GZ8MTXP01ARL6I.13.28.C06.1.454.CMB.2.raw
  modified_base (283)..(283): a, c, t, g, unknown or other
  modified_base (343)..(343): a, c, t, g, unknown or other
  modified_base (469)..(469): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccaggccgtgggggtccctgagactctcctgtgtagcctctggtatttgttttagngtactatggatgaggttggtccgccaggctccgagggaaggggctggagtgggtgccaanataaagtacgatagaagttgagtaattaaattagtttggactcgtagtgaagggcctagttcaccatcgtacgagggacaacgaccaagaactcgctagtatctgacaaatggagagccgtagagngacccggaggacgacggtcgtagtattaagttgttgtggttaagagttagttaagccgtcaatttaccgtttgaccgtcggtagggggccccgaaggggtaaccccgttggggtaacccaaccccggtttcccg

SEQ ID NO: 375145 - DNA, 608 bp, Homo sapiens
  misc_feature: GZ8MTXP01DGNRI.13.28.C06.1.454.CMB.2.raw
  modified_base (349)..(349): a, c, t, g, unknown or other
  modified_base (513)..(513): a, c, t, g, unknown or other
  modified_base (602)..(602): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggaggtccgggggagacttggtccagccgtgggggtccctgagactctcctgtgtagcctctggtatttgttttagtgacttatggatgagttgggtccgccgaggctccgaggggaggggctgggaggtggggtggaccaanaagtaaagtacgagttagaagttgaagtaattaaatttatttggacttcgtagtaggaagggccgtattcactatcgtgagggacaagaccaaagacctcgactagtactctagacaaagtgggaagacggcctagggacgacggccggaaggaccgacgggtntagtattagtttagtggtgtaagtagttagtcgcgtactacttacgttcggacgttaagggcggggaacctacgggtaccttcggtccnccgtcc

SEQ ID NO: 375146 - DNA, 620 bp, Homo sapiens
  misc_feature: GZ8MTXP01B2U5T.13.28.C06.1.454.CMB.2.raw
  modified_base (335)..(335): a, c, t, g, unknown or other
  modified_base (381)..(381): a, c, t, g, unknown or other
  modified_base (412)..(412): a, c, t, g, unknown or other
  modified_base (444)..(444): a, c, t, g, unknown or other
  modified_base (507)..(507): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattgggctgaactgggtttccttgttgctatttagaaggtgtcagtgtgaagtgcacctggtggaggtccggggagacttggtccagccgtgggggtccctgagactctctgtgtagcctcgtggtattttgttttagtgacttatggatgaggttgggtccgcgaggctccgaggggaggggctggaggtgggngaccaactagtaaagtcgatagaaagttgaagtaattaaaagtttnttggactgtaaggtgaagggccattcgaaantcgacggaacgggacacgccaaaggactcggntagtatctagataaagtggaagcgtccgaggaacggacgacccgggaaggtaccgaccgggtntttaggtttaaataagtttgttcggtgtaaggattaccgttgcgtacacttttagttcgacgttaacgggcggggaacctacgggggacccttgggtaacccaacggttcccc

SEQ ID NO: 375147 - DNA, 831 bp, Homo sapiens
  misc_feature: GZ8MTXP01EEK8B.13.28.C06.1.454.CMB.2.raw
tcagtcacgtactacacgaccggtgctcgattagagctcacgtattgggtttgggggaggtctcagagaggagccttagccctggactccaaggcctttccacttggtgatcagcactgagcacagaggactcaccatggaattggggctgaacttgggttttccttgttgcttatttagaaggtgtcagtgtgaagtgcaccgtggtgggaggtccgggggagacgttgggtccacggcccggttggggggtccctggacgactctccgtgtgtacgtcctcgttggttattttggtttagtgtattagtggtagtggtaggttcgggtcccgccgacgggtccgtaccggaaaggggggtaacgggggtcggttagggggtacggggtcgggggtacggaacccgaaaacgtaaagttaaaaacgggtacggtaagttaaggtaaaggttaggaaagtaaacgtttaaaagttttaggtttacggtacgtttacggttaaggttaacgggtaacgggggtaccctaacgtttacccaacccgtaacgtaccgggtacggggaaaccgggggaaaccaaacccggaccccgaaaaggtaacccgttccgtacgttaaggttacttacgaagaactaaaagggtgggaaacgtacggtaccggagggaacggtaaccggacgggaaacgaacccggtggtacttaaggttaatttaatttggtttcgtggaaagtacggttaaattccgcgtacttaacgtttacgttggaaccgttcggggtacgggaaccgtaaccggggtacccttggggtccccttaacccgttccc

SEQ ID NO: 375148 - DNA, 740 bp, Homo sapiens
  misc_feature: GZ8MTXP01CF8FK.13.28.C06.1.454.CMB.2.raw
  modified_base (607)..(607): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctatttagaaggtgtccagtgtgaagtgcacctggtggaggtccgggggagacttggtccaggccgtggggggtccctgagactctcctgtgtagtcctctggtattttgttttagtgtactagtggatggtaggttgggtcccgcgagggcctccggaaggggaagggggtcgtggggagggtgggggtacggacccaaacgtaagtaaaaggtacggtagtaggtaaaggttgaaggtaattaaaatttagtttacggtactcgttaagggtacgggaacggggtcctaacgttacccaaccgtactcggtacgggaaacgggtaaccaaaccgggaccaaagtaacctggcttaggtaatcctagactaaaagtcggggaatacggtccggtagggaacggacgggaccccgggaaagggacccgtaacgggttnttaggttaattaagttttaggttggtggtaacggtaagttatacggaccgtaactaaccgtttcgttacggacggttaacggggtccggggaacccgtaacggggtaccccgttggtaaccccttcccgttcc

SEQ ID NO: 375149 - DNA, 678 bp, Homo sapiens
  misc_feature: GZ8MTXP01BAXGA.13.28.C06.1.454.CMB.2.raw
  modified_base (282)..(282): a, c, t, g, unknown or other
  modified_base (504)..(504): a, c, t, g, unknown or other
  modified_base (554)..(554): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggtttccttgttgctatttagaaggtgtccagtgtgaagtgcacctggtggaggtccgggggagacttggtccagccgtgggggtccctgagactctcctgtgtagcctctggtattttgttttagngtactatggatgagttggtccgccgaggctcgagggaaggggctgggagtgggtggaccaacaagtaaagtacgatagaaagttgaagtaattaaaatttagtttggaacttcgtaggtagggaacggggccgtaattccaaccgatacgtacgggaacggggaaccaaaccggacccaaaggaaccttaccggcttaggtaacttcgtagactaaaaaggngggaacgacgtcggtaggaacgggaccggacccggaagggaccgacggtnttaggttattaagttgttggtgtaaggaagttacgttacggccgtacttaacttacgtttcgaaccgttaacgggtcgggggaaccccgtaacgggtaccccgttggtaacccgttcccgttcc

SEQ ID NO: 375150 - DNA, 647 bp, Homo sapiens
  misc_feature: GZ8MTXP01BNFRO.13.28.C06.1.454.CMB.2.raw
  modified_base (289)..(289): a, c, t, g, unknown or other
  modified_base (356)..(356): a, c, t, g, unknown or other
  modified_base (515)..(515): a, c, t, g, unknown or other
  modified_base (543)..(543): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaacttgggttttccttgttgctattttagaaggtgtccagtgtgaagtgcaccgtggtggaggtccgggggagacttggtccaggccgtggggggtccctgagactctcctgtgtagcctctggtattttgtttttagngtacttatggatggtagttgggtcccgcaggctccggaggggaggggctggaggtgggtggaccaanagtaaagtacgattagaagttgaagtaattaaactttagtttaggacctttcgtaggtacgggaacggggtcccgtaatttccgaacctagttccgtacgggaacggggaccaaaccggacccaaaggacctcgcttaggtactctagacaaagtgganacgcgtagacggacgcgaggcgacggtnttagtattattgttgtgtgtagttagttacgcgtactacgtttacgttcgaccgttaacgggcggggaaccgtacgggtacccgttggtaacccgttcccgtcc

SEQ ID NO: 375151 - DNA, 661 bp, Homo sapiens
  misc_feature: GZ8MTXP01EP7ZV.13.28.C06.1.454.CMB.2.raw
  modified_base (273)..(273): a, c, t, g, unknown or other
  modified_base (289)..(289): a, c, t, g, unknown or other
  modified_base (548)..(548): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaacttgggttttccttgttgcttattttagaaggtgtccagtgtgaagtgcaccgtgggtggaggtccgggggagacgttgggtccaggccgtggggggtccctgagctctcctgtgtgcctntggtatttgttttagngtactatggatgtaggttgggtccgcgaggctccggaggggaggggcgtgggaggtggggtggaccaaacaagtaaagtacgattaggaaagttgaagtaaattaaagtttagtttaggacttcgtagggtagggaacggggtcctaagttccacctatcgtacgggacgggaaccaaacgaccaaagtaaccgtcgacttagtattccaggaacaaagtgggaagcggtacggtggaacggagcccgggaaggacccncggggcttaggttattagttagttggtggtaagagttacgtgcgactacttacgtttgaaccgttcgggcggggaaccgacggggtacccttcgggtcccaacccggtttccc

SEQ ID NO: 375152 - DNA, 637 bp, Homo sapiens
  misc_feature: GZ8MTXP01DQAWF.13.28.C06.1.454.CMB.2.raw
  modified_base (505)..(505): a, c, t, g, unknown or other
  modified_base (525)..(525): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgcttattttagaaggtgtccagtgtgaagtgcacctggtggagtccgggggagacttggccagccgtgggggtccctgagactctcctgtgtagcctctggtatttgttttagtgactatggatgagttggtccgcaggctccgaggggaaggggctgggaggtgggtaggaccaaacgtaagtaaaaggtacgataggtaaagttgaagtaattaaaatttagtttggaacttcgtaggttaggaaggggccgtaatttaccaaccgatccgtacgggaagggaaccaaaccgccaaaaggaacctcgacgtagttactctagacaaagtgggaancgcgtagagacgccgagacnggctagtatattatgtgtaagtagttattacgcgtactaactttacgtttgaaaccgttcggtagggggaacccgtaaggggaccccttgggtaaccgttccctttaacccg

SEQ ID NO: 375153 - DNA, 665 bp, Homo sapiens
  misc_feature: GZ8MTXP01BVMHC.13.28.C06.1.454.CMB.2.raw
  modified_base (223)..(223): a, c, t, g, unknown or other
  modified_base (286)..(286): a, c, t, g, unknown or other
  modified_base (564)..(564): a, c, t, g, unknown or other
  modified_base (575)..(575): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaacttgggttttccttgttgcttattttagaaggtgtccagtgtgaagtgcacgtggtggaggtccggggganacgttggtccaggtccgtgggggtccctgagactctctgtgtagcctgtgtatttgttttagngtactagtggatggtaggttcgggtccgccgaggctccggaagggggaaggggcgtggggaggtgggggtacggaccaaagaagtaaaaggtacgagttaggtaaagttggaagtaaattaaatttagtttagggaacttcgtagggtacgggaagggtccctaagttccaacctagtccgtacgggaacggggaaccaaaccggacctaaaggaaccttcgacttagtactctagacaaagtggaagcgccggtagagacgccgaaggtccacggtntagtatagttntgtgtggattacttggcgtactactttacgtttgaccttaacgggcggggaaccctaacgggtaaccccgttggtcccttaacccgtccc

SEQ ID NO: 375154 - DNA, 585 bp, Homo sapiens
  misc_feature: GZ8MTXP01CSAGO.13.28.C06.1.454.CMB.2.raw
  modified_base (278)..(278): a, c, t, g, unknown or other
  modified_base (376)..(376): a, c, t, g, unknown or other
  modified_base (450)..(450): a, c, t, g, unknown or other
  modified_base (482)..(482): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggtttccttgttgctattttagaaggtgtccagtgtgaagtgcacctggtggagtccggggagactggtccagccgtgggggtccctgagactctcctgtgtagcctctggatttgttttagngtactatggatgagttggtccgcaggctcgagggaggggctggagtgggtgaccaacataaagacgatagaagttgaagtaattaaattattggactntagtagaagggccattcaccatcgtcgagggacaacgccaaagactcgactagtactcagactaaaagtggaanacgccgtaggaggaacgccgaaggacacggtntagtatagttagtgtgtaagaagttacgtacgcgtaactaacgtttacgttcgacgtcgggtacggggaacctaacggggtaccttcggtcccttaaccgtcc

SEQ ID NO: 375155 - DNA, 661 bp, Homo sapiens
  misc_feature: GZ8MTXP01CT0VY.13.28.C06.1.454.CMB.2.raw
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtggggggtccctgagactctcctgtgtagcctctggtattttggtttttagtgtactagtggatggagttgggtccgcaggctccgaggggaggggctggagtggggtggaccaacgaagtaaagtacgatggaagttgaagtaacttaaatttagtttggactctaggtaggaaggggccctattcgaccatctacggagggaccaacgaccaagactcgctagtatcgtgacaaagtggagtagccgtggaggacgaccggaggaacacgggcttaggtaattagtttagttggtgttaaggtaacgttagtttacggccgtaacctacgtttaaccgttttcggaaccgtttaaccggggtcggggggtaacccctacggggggtaaccccccttagggggtaaccccttaacccgggttcccc

SEQ ID NO: 375156 - DNA, 673 bp, Homo sapiens
  misc_feature: GZ8MTXP01BM31Y.13.28.C06.1.454.CMB.2.raw
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaacttgggttttccttgttgcttattttagaaggtgtccagtgtgaagtgcacctggtggaggtccggggagacttggtccagccgtgggggtccctgagactctcctgtgtagcctctggtattttgttttagtgtactatggatgaggttggtccgcgaggctcgagggaggggcgtgggaggtgggtcgaccaacgaagtaaaggtacgagttaggaagttagaagtaattaaatttagtttaggacttcgtagtagggaacgggtccgtaattaccacctaagttcgtacgggaacgggtaccaaacgaccaaagaacctcgacttagtaactcgtaggaacaaagtgggaagcgccgtaggaaggacgacccggtaggaacccgcggtattaggtaattagtttagttggtggtaagtaacgttagttacgccgtacgtaactttaacgtttcgaaccgttaacggtcgggggaaccgtaacggggtaaccccgttggttaaccccgaaccgtttccc

SEQ ID NO: 375157 - DNA, 736 bp, Homo sapiens
  misc_feature: GZ8MTXP01BEF9T.13.28.C06.1.454.CMB.2.raw
  modified_base (224)..(224): a, c, t, g, unknown or other
  modified_base (288)..(288): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaacttgggttttccttgttgcttattttagaaggtgtccagtgtgaagtgcaccgtggtggaggtccggggganacgttggtccaggccgtgggggtccctgagctctcctgtgtagcctgtggtattttgttttagngtacttagtggatggtagttcgggtccgcgaggctaccgaggggaaggggcgtgggaggtggggtacgaccaaactaagtaaaaggtacgagttaggaagttggaagtaattaaaagtttagtttggacttcgtaaggttagggaacgggccgtaaatttccaaccgtattccgtacgggaacggggtaaccaaaccggtcccaaaaggtaaccttccggacttaaggttaacttccgtaggaaacctaaaaggtgggaaacgtacggtcccgttaggggaaacggaccgggaccccgggaaagggaacccgtaccgggtatttaaggttaatttaagttttagttgggtagtaagtaacgttattacggcgtacctaacgttttacgttggaaccttcgggtacggggccgtaacgggtacccttgggtcccttaacccggttcccc

SEQ ID NO: 375158 - DNA, 864 bp, Homo sapiens
  misc_feature: GZ8MTXP01AX8JR.13.28.C06.1.454.CMB.2.raw
  modified_base (221)..(221): a, c, t, g, unknown or other
  modified_base (268)..(268): a, c, t, g, unknown or other
  modified_base (284)..(284): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggaggtccggggganacttggtccagccgtgggggtccctgacgtactctctgtgtagcctntggtatttgttttagngtactatggatggtaggttgggtccgccgaggcctaccggaggggaaggggtctggggaggtggggtacggacccaaacgtaagtaaaacggtacggattaggtaaaggtttgaaaggtaatttaaaacgtttagtttagggaaccttgttagggtacgggaacggggtcccgtaaactttcccgaacccgtacgttaccgggtaaacggggaaaccggtaaacccgaaacccggtaaccgtaaaaacggtcccggttaccgtaccggtttaaggtaacctttacggacgtaaaaccggtaaacggggtggaaacgcccggttacggggaaacgggaacggggacccgggtaaccggaacgggtaaaccccgggtcggttaaggtttaagtttaaagttttaggttttaaggtgggttaaagggggtaaccttaaaggtttaaacggtcccgggccgttaaaactttaaccgttttaccgggtttaacgggttaaccccggtttaaggggggtacccccggggaaccggtaaaccccggggtttcccggttccggttaaccccgttaaccccggttcccc

SEQ ID NO: 375159 - DNA, 633 bp, Homo sapiens
  misc_feature: GZ8MTXP01CI096.13.28.C06.1.454.CMB.2.raw
  modified_base (284)..(284): a, c, t, g, unknown or other
  modified_base (552)..(552): a, c, t, g, unknown or other
  modified_base (593)..(593): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtgggggtccctgagactctcctgtgtagcctctggtattttgtttttagngtactatggatgaggttgggtccgcaggctccgaggggaggggctggaggtgggtggaccaaagagtaaaagtacgatggaaagttggaagtaattaaaagtttagtttgggaacttcgtaggttagggaacggggccgtaattccgaaccagttcgtacggaagggaccaaacgccaaagaactcgcttgtaactcgtgacaaagtggagagccggtggacgcggaccggaacggacgacgggtctaggttattaagtttagttggngtaagtagagtttagcgtactacttagtttcgacgttcggnggggtcccaggggttaccccttgggtcccaaccggttccc

SEQ ID NO: 375160 - DNA, 694 bp, Homo sapiens
  misc_feature: GZ8MTXP01B9SCV.13.28.C06.1.454.CMB.2.raw
  modified_base (524)..(524): a, c, t, g, unknown or other
  modified_base (560)..(560): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaacttgggttttccttgttgcttattttagaaggtgtccagtgtgaagtgcaccgtggtggaggtccgggggagtacgttggtccaggccgtcgggggtccctggagactctcctgtgtagcctctggtattttgtttagtgtactagtggatggtaggttggccgcgaggtcgtccggaaggggaacggggcgtgggaggttggggtcggaccgaaataagtaaaggtacgagtagtaaaggttgaagtaaattaaagtttagtttaggtaactcgtaaggtagggaacgggcctaacgttaccgactagtcgtacgggacggtacaaccggacaaagtactcgagttagtactgtaggaacaaagtgggaanacggccgtagggaacggacgacccggaagaacccgngggtcttaaggttattaagtttagttgtggttaagaagttagttacggactacgtacgtttaacgtttggaacccgttaaggggtccgggaaccgaacgggttaccccgttcgggtaaccttaaccccgttccc

SEQ ID NO: 375161 - DNA, 696 bp, Homo sapiens
  misc_feature: GZ8MTXP01CDCAL.13.28.C06.1.454.CMB.2.raw
  modified_base (578)..(578): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctatttagaaggtgtccagtgtgaagtgcacctggtggagtccggggagacttggtccagccgtgggggtccctggacgtctctcgtgtgtcgtcctgtgtgttttgtttgtgtactagtgagtggtaggttcggtccgcgcggctacggaggggagggcgtgggtagggtggacgtacgactaagtaaacgtaagtagtaagtagtaagtagtaaagttaatttaacgttagttacgtacgttacggtagggtaacgggacggtaccgtacttaccgtacgtacgtacgggtacgggaaaccgacaaaccggacgtacggtacgttcgtattacgtactcgtaaacgaggtaaagcgggacgacggtccggaggaaccggacggacgtaacggcccgtagttacgttnttaaacgttgttgtagggtaagtagttacgtacgttcgaccgttacttaacggtttcaacggttcgggtaccgggaacgggtacccggtaaccggttccgtcggttcccgttaacccg

SEQ ID NO: 375162 - DNA, 655 bp, Homo sapiens
  misc_feature: GZ8MTXP01AL9Y6.13.28.C06.1.454.CMB.2.raw
  modified_base (286)..(286): a, c, t, g, unknown or other
  modified_base (308)..(308): a, c, t, g, unknown or other
  modified_base (336)..(336): a, c, t, g, unknown or other
  modified_base (412)..(412): a, c, t, g, unknown or other
  modified_base (464)..(464): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattgggtctgaactgggttttccttgttgctattttagaaggtgtccagtgtgaagtgcacctggtgggaggtccgggggagacttggtccaggccgtggggggtccctgagactctctgtgtagcctctggtattttgttttagngtactatggatgagtgggtccncaggctcgaggggagggctggagtgggngacaagataaagtacgatagaagttgagtaataaattattggactcgtaggtaggaacgggcctattcacctatcncggagggacaacgaccaaagactcgactagtactcgtagacaaagtgggaanaggtccgtaggacggacggacccgggaaggaacccgtacgggtcttagggttaattaagttttaagtttggtggtaaggtaacgttatttacgggccgttacctaaacgtttacgtttggaacccgttaacgggtcggggggaaccctaacggggggtaaccccttggggtaaccccttaacccggttccc

SEQ ID NO: 375163 - DNA, 655 bp, Homo sapiens
  misc_feature: GZ8MTXP01EIC6L.13.28.C06.1.454.CMB.2.raw
  modified_base (451)..(451): a, c, t, g, unknown or other
  modified_base (457)..(457): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggaggtccgggggagacttggtccagccgtggggggtccctgagactctcctgtgtagcctccggtatttgtttagtgactattggatgagttgggtcgcaggctccgagggaagggctggagtgggtggacaacagtaaagtacgataggagttagagaattaaactttattaggactcgtagtaggaagggcgtattacaccatcgtcggaagggaaccacgaccaaagaactcgctgtactntacganaaatggaagacgcctagggggacgaaggaccggacggaacaccggtgttaggtaaattagtttaagttggtaggttggtaagtaagtttaggcgacgtaacctttaacgtttacggttaaaccgttacgggttcgggggacccgtaaccggggtaaccccggtggttacccgtaacccgggttcccgtttaacccccg

SEQ ID NO: 375164 - DNA, 703 bp, Homo sapiens
  misc_feature: GZ8MTXP01A82M1.13.28.C06.1.454.CMB.2.raw
  modified_base (304)..(304): a, c, t, g, unknown or other
  modified_base (496)..(496): a, c, t, g, unknown or other
  modified_base (521)..(521): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaacgttgggttttccttgttgcttattttagaaggtgtcagtgtgaagtgcaccgtggtgggaggtccgggggagtacgttggtccacggccggtcggggggtccctggacgacttctccgtgtgtacgccttcgttggtatttttgttttagngtacttagtggattggtaggttcggtccgcgaggctacggagggggacggggcgtggggaggtggggtacgaccaaacgaagtaaaggtacgataggaagttgaagtaaattaaatttagttaggacttcgtaagggtaggaacgggtcctacttccactactcgcggaacgggacaacgaccaagactcgntagtatcgagacaaagtggaaacgngtaccggtagacggaacgcccggaaaggaacccctagggtattagttaagttagtttagtggtggtaagtaaagttacctaggaccgtaacttacgtttacgtttcggaaaccgtttaacgggggacggggtaaccccgaacggggtacccctttccggggaaccttaacccccggtttccg

SEQ ID NO: 375165 - DNA, 538 bp, Homo sapiens
  misc_feature: GZ8MTXP02JWWDT.13.28.C06.1.454.CMB.2.raw
  modified_base (368)..(368): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctgggggtccctgagactctcctgtgtagcctctggatttgttttagtgactattggatgagttggtccgccaggctccgagggaggggctggagtgggtggccaacataaagtacgatgaagttgagataaattnttggactctgtgagggccgattcacatctcgagggacaacgccaagaactcgctgtatctgcaaatggagagcctggagagccgaggacacggctgtatattatgtgtgagattagcgactactactttgactaacgtgggggaccaggggacccctggtaccaccgtcc

SEQ ID NO: 375166 - DNA, 719 bp, Homo sapiens
  misc_feature: GZ8MTXP02JN0VU.13.28.C06.1.454.CMB.2.raw
tcagtcacgtactacacgaccggtgctcgattagagctcacgtattgggtttggggaggtctcagagaggagccttagccctggactccaaggcctttccacttggtgatcagcactgagcacagaggactcaccatggaattgggtctgaactgggttttccttgttgctattttagaaggtgtccagtgtgaagtgcacctggtggaggtccgggggagacttggtccaggccgtggggggtccctggagactctcctgtgtagcctctggtatttgttttagtgactattggatgagttggtccgcgaggctccgagggaaggggcgtgggaggtggggtggaccaaacgaagtaaaagtacgaatagtaagttagaagtaattaaaatttagtttaggtaacttcgttaggttagggaacgggggtcccgtaaacgtttaccgaaccctaacgttaccgttaccgggaaacgggggaaacccaaacccggaccctaaaaacggaaacccttcggaccttaggtaactccgtagaaccaaaagtgggaagacgccgtaggaagacggcccgggaaggaaccgagggtcttagttaattaatttagttggtgttagaacgtaagtttacggaccacttaacttaacgttttgaaccgttaacgggtacgggggacccaaacgggggtaacccccttgggtacccaacccggtttccc

SEQ ID NO: 375167 - DNA, 545 bp, Homo sapiens
  misc_feature: GZ8MTXP02GS9YV.13.28.C06.1.454.CMB.2.raw
tcagtcacgtactacacgaccggtgctcgattagagctcacgtattgggtttgggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgttttagtgactattggatgagttggtccgccaggctccgagggaggggctggagtgggtggccaacataaagtacgatgaagttgagataaattattggactctgtgaggggccattcaccatctcgagggacaacgccaagaactcgctgtatctgacaaaatggagagcctgagagccggaggacacggctgtatattatgtgtgagattacgcgactacttactttgaacttaacgtcgggggccaggggtaaccctgggtccaccgtc

SEQ ID NO: 375168 - DNA, 581 bp, Homo sapiens
  misc_feature: GZ8MTXP02H7O64.13.28.C06.1.454.CMB.2.raw
  modified_base (264)..(264): a, c, t, g, unknown or other
  modified_base (380)..(380): a, c, t, g, unknown or other
  modified_base (398)..(398): a, c, t, g, unknown or other
  modified_base (446)..(446): a, c, t, g, unknown or other
  modified_base (476)..(476): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccggggagacttggtccagccgtgggggtcctgagactctcctgtgtagcctntggtatttgttttagtgactattggatgagttggccgcaggctcgagggaaggggctggagtgggtgccaaacagtaaaagtacgatgaaagttgaagaataaaattattggactntgtgagggcatcacatcncgagggacaacgcaagaactcgctgtaatctagaacaaaagtgggaanagcctagaagagacccggaggacacgggtntagttaattattagtgtagtagaagtacttacggcacctaacgttacgtttacgaacgttaacggtcggggacccgaacggggtaaccctgggtacccaccgtcc

SEQ ID NO: 375169 - DNA, 536 bp, Homo sapiens
  misc_feature: GZ8MTXP02FSQRN.13.28.C06.1.454.CMB.2.raw
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggatttgttttagtgactattggatgagttgggtccgccaggctccgaggggaaggggctggagtgggtggccaacataaagtacgatgaagttgagataaattattggactctgtgagggccattcaccatctcgagggacaacgccaaagaactcgctgtatctgcaaaatggagagcctgagagccgaggacaggctgtatattattgtgtgagattacgcgcacttacttgactaagtcggggccacggggaccctggcaccgtc

SEQ ID NO: 375170 - DNA, 557 bp, Homo sapiens
  misc_feature: GZ8MTXP02HR9BD.13.28.C06.1.454.CMB.2.raw
  modified_base (400)..(400): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtggggggtccctgagactctcctgtgtagcctctggtatttgttttagtgtactattggatgagttggtccgcaggctcgagggaggggctggaggtgggtggccaacagtaaagtacgatgaagtgagaataaattattggactctgtgagggccattcacatcncgagggacaaacgccaaagactcgcttgtatctgacaaagtgggaagagcctaggagagccggaagacgacggctaggtatattatgtgtgagtattagcgtactacttactttgacttaacgtgggggcccaagggacccctggtccctaccgtcc

SEQ ID NO: 375171 - DNA, 559 bp, Homo sapiens
  misc_feature: GZ8MTXP02GT7SJ.13.28.C06.1.454.CMB.2.raw
  modified_base (345)..(345): a, c, t, g, unknown or other
  modified_base (381)..(381): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagccgtggggggtccctgagactctcctgtgtagcctctggtatttgttttagtgacttattggatggagttgggtccgccaggctccgagggaggggctggagtgggtggccaanataaagtacgatgaagtgagataaattattggactntgtgagggccattcacatctcgagggacaacgccaaagaactgctgtactctgacaaagtggaagagcctggaagacgccgaaggacacgggctgtatattagttgtgtgagtacttagcgtcaacgttacttgactaacgtcggggaccagggggaacccctggtcccaccggttcc

SEQ ID NO: 375172 - DNA, 563 bp, Homo sapiens
  misc_feature: GZ8MTXP02IFWW0.13.28.C06.1.454.CMB.2.raw
  modified_base (348)..(348): a, c, t, g, unknown or other
  modified_base (387)..(387): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggaggtccgggggagacttggtccagccgtggggggtccctgagactctcctgtgtagcctctggtattttgttttagtgactattggatggagttggtccgccaggctccgaggggaggggctggaggtggggtggccaanagtaaagtacgatgaagttgagataaaattgttggactntgtgaggggccattcacatctgaggacaacgccaaagactcgctagtatctgacaaatgggaagagcctaggagacgcggaggacacggctgtatattagtgtgtgagtattacgcgctacttactttcgacgttaacgtcgggggaccaggggaacccctgggtaccaccgttcc

SEQ ID NO: 375173 - DNA, 589 bp, Homo sapiens
  misc_feature: GZ8MTXP02HPWEU.13.28.C06.1.454.CMB.2.raw
  modified_base (382)..(382): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctatttagaaggtgtccagtgtgaagtgcacctggtggagtccgggggagacttggtccagcctggggggtccctgagactctcctgtgtagcctctggatttgttttagtgactattggatgagttgggtccgccaggctccaggggaaggggctggagtggggtggccaaacataaagtacgatgaagttgagattaaattatttggactntgtgagggccgattcaccatctgagggacaacgcaaagaactcgctgtatctgcaaaagtggaagtagcctaggaagagaccgaagggactacgggattggtaatatttagttggtgttagaggtaatttacgcgactacgttaacctttgaaccgtaacgtcgggggaccctaacgggggaaccccttgggacctacccggttccc

SEQ ID NO: 375174 - DNA, 561 bp, Homo sapiens
  misc_feature: GZ8MTXP02F83U2.13.28.C06.1.454.CMB.2.raw
  modified_base (379)..(379): a, c, t, g, unknown or other
  modified_base (471)..(471): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattgggtctgaactgggttttccttgttgctattttagaaggtgtccagtgtgaagtgcacctggtggagtccgggggagacttggtccagccgtgggggtccctgagactctcctgtgtagcctctggatttgttttagtgactattggatgagttgggtccgccaggctccgagggaaggggctggagtggggtggccaacataaagacgatgaagttgagataaattattggactntgtgagggccatcacatctcgagggacaaacgccaaagaactcgctgtatctagacaaaagtgggaagagcctaggagagcccgaggaaccncgggctgtaatattatgtgtgagattagcgactactactttgaacctaacgtcgggggaccaacgggggaaccccttggacccacgttcc

SEQ ID NO: 375175 - DNA, 624 bp, Homo sapiens
  misc_feature: GZ8MTXP02G377K.13.28.C06.1.454.CMB.2.raw
  modified_base (282)..(282): a, c, t, g, unknown or other
  modified_base (393)..(393): a, c, t, g, unknown or other
tcagtcacgtactacacgaccggtgctcgattagagctcacgtattgggtttggggaggtctcagagaggagccttagccctggactccaaggcctttccacttggtgatcagcactgagcacagaggactcaccatggaattggggctgaactgggttttccttgttgctattttagaaggtgtccagtgtgaagtgcacctggtggagtccgggggagacttggtccagcctggggggtccctgagactctcctgtgtagcctctggtatttgttttagngactattggatgagttggtccgcaggctcgagggaggggctggagtgggtgccaacagtaaagacgatgaagttgagataaattattggatctgtagagggcatcacatcngagggacacgccaaagacctcgcttagtatctagactaaaagtgggaagagtcccgtaggaaggacggacccgggaaaggaaccgaaccggggttacttaggttaactttaagtttagttggttaggtaggtagtaacgttacggacctacttaaccgtttacgtttacggaccgttaacgggtcgggggaacccgtaacgggggtaccccttcggtaccctaccgttccc
